US009512408B2

(12) United States Patent
Li et al.

(10) Patent No.: US 9,512,408 B2
(45) Date of Patent: Dec. 6, 2016

(54) POLYPEPTIDES WITH KETOL-ACID REDUCTOISOMERASE ACTIVITY

(71) Applicant: Butamax™ Advanced Biofuels LLC, Wilmington, DE (US)

(72) Inventors: Yougen Li, Pennington, NJ (US); Jessica McElvain, Wilmington, DE (US); Steven Cary Rothman, Wilmington, DE (US)

(73) Assignee: Butamax Advanced Biofuels LLC, Wilmington, DE (US)

( * ) Notice: Subject to any disclaimer, the term of this patent is extended or adjusted under 35 U.S.C. 154(b) by 0 days.

(21) Appl. No.: 14/038,455

(22) Filed: Sep. 26, 2013

(65) Prior Publication Data

US 2014/0093930 A1    Apr. 3, 2014

Related U.S. Application Data

(60) Provisional application No. 61/705,977, filed on Sep. 26, 2012.

(51) Int. Cl.
*C12N 15/52* (2006.01)
*C12N 9/04* (2006.01)
*C12P 7/16* (2006.01)

(52) U.S. Cl.
CPC ............ *C12N 9/0006* (2013.01); *C12N 15/52* (2013.01); *C12P 7/16* (2013.01); *C12Y 101/01086* (2013.01); *Y02E 50/10* (2013.01); *Y02P 20/52* (2015.11)

(58) Field of Classification Search
USPC .................................. 435/160, 254.21, 320.1
See application file for complete search history.

(56) References Cited

U.S. PATENT DOCUMENTS

| | | | |
|---|---|---|---|
| 4,683,202 A | 7/1987 | Mullis et al. | |
| 4,865,973 A | 9/1989 | Kollerup et al. | |
| 5,643,779 A | 7/1997 | Ehrlich et al. | |
| 6,586,229 B1 | 7/2003 | Ben-Bassat et al. | |
| 7,541,173 B2 | 6/2009 | Bramucci et al. | |
| 7,659,104 B2 | 2/2010 | Bramucci et al. | |
| 7,851,188 B2 | 12/2010 | Donaldson et al. | |
| 7,910,342 B2 | 3/2011 | Liao et al. | |
| 7,993,889 B1 | 8/2011 | Donaldson et al. | |
| 8,017,364 B2 | 9/2011 | Bramucci et al. | |
| 8,071,358 B1 | 12/2011 | Dundon et al. | |
| 8,129,162 B2 | 3/2012 | Li et al. | |
| 8,178,328 B2 | 5/2012 | Donaldson et al. | |
| 8,188,250 B2 | 5/2012 | Bramucci et al. | |
| 8,206,970 B2 | 6/2012 | Eliot et al. | |
| 8,222,017 B2 | 7/2012 | Li et al. | |
| 8,241,878 B2 | 8/2012 | Anthony et al. | |
| 8,273,558 B2 | 9/2012 | Donaldson et al. | |
| 8,283,144 B2 | 10/2012 | Donaldson et al. | |
| 8,372,612 B2 | 2/2013 | Larossa et al. | |
| 8,389,252 B2 | 3/2013 | Larossa | |
| 8,455,224 B2 | 6/2013 | Paul | |
| 8,455,225 B2 | 6/2013 | Bramucci et al. | |
| 8,465,964 B2 | 6/2013 | Anthony | |
| 8,518,678 B2 | 8/2013 | Flint et al. | |
| 8,557,562 B2 | 10/2013 | Bramucci et al. | |
| 8,614,085 B2 | 12/2013 | Van Dyk | |
| 8,637,281 B2 | 1/2014 | Paul et al. | |
| 8,637,289 B2 | 1/2014 | Anthony et al. | |
| 8,652,823 B2 | 2/2014 | Flint et al. | |
| 8,669,094 B2 | 3/2014 | Anthony et al. | |
| 8,691,540 B2 | 4/2014 | Bramucci et al. | |
| 8,735,114 B2 | 5/2014 | Donaldson et al. | |
| 8,765,433 B2 | 7/2014 | Gude et al. | |
| 8,785,166 B2 | 7/2014 | Anthony | |
| 8,795,992 B2 | 8/2014 | Bramucci et al. | |
| 8,828,694 B2 | 9/2014 | Anthony et al. | |
| 8,828,704 B2 | 9/2014 | Donaldson et al. | |
| 8,871,488 B2 | 10/2014 | Dauner et al. | |
| 8,889,385 B2 | 11/2014 | Donaldson et al. | |
| 8,895,307 B2 | 11/2014 | Li et al. | |
| 8,906,666 B2 | 12/2014 | Alsaker et al. | |
| 8,911,981 B2 | 12/2014 | Li et al. | |
| 8,940,511 B2 | 1/2015 | Larossa et al. | |
| 8,945,859 B2 | 2/2015 | Donaldson et al. | |
| 8,945,899 B2 | 2/2015 | Li et al. | |
| 8,951,774 B2 | 2/2015 | Donaldson et al. | |
| 8,951,937 B2 | 2/2015 | Flint et al. | |
| 8,956,850 B2 | 2/2015 | Anthony et al. | |
| 8,962,298 B2 | 2/2015 | Donaldson et al. | |
| 2002/0061569 A1 | 5/2002 | Haselbeck et al. | |
| 2004/0234649 A1 | 11/2004 | Lewis et al. | |

(Continued)

FOREIGN PATENT DOCUMENTS

EP    2204453    7/2010
WO    WO9408020    4/1994

(Continued)

OTHER PUBLICATIONS

Abbad-Andaloussi et al., Carbon and Electron Flow in Clostridium butyricum grown in Chemostate Culture on Glycerol and on Glucose, Microbiology 142:1149-1158, 1996.
Arthur, et al., Contribution to VanY D,D-Carboxypeptidase to Glycopeptide Resisance in Enterococcus faecalis by Hydrolysis of Peptidoglycan Precursors, Antimicrob. Agents Chemother. 38:1899-1903, 1994.
Aulabaugh, et al., Oxalyl Hydroxamates as Reaction-Intermediate Analogues for Ketol-Acid Reductoisomerase, Biochemistry 29:2824-2830 1990.
Biou, et al. The crystal structure of plant acetohydroxy acid isomoreductase complexed with NADPH, two magnesium ions and a herbicidal transition state analog determined at 1.65 Å resolution, EMBO Journal 16:3405-3415, 1997.

(Continued)

*Primary Examiner* — Kagnew H Gebreyesus

(57) ABSTRACT

Polypeptides having ketol-acid reductoisomerase activity are provided. Also disclosed are recombinant host cells comprising isobutanol biosynthetic pathways employing such polypeptides. Methods for producing isobutanol employing host cells comprising the polypeptides having ketol-acid reductoisomerase activity are also disclosed.

9 Claims, 2 Drawing Sheets

(56) References Cited

U.S. PATENT DOCUMENTS

| | | | |
|---|---|---|---|
| 2004/0248250 | A1 | 12/2004 | Nakai et al. |
| 2005/0112739 | A1 | 5/2005 | Golubkov et al. |
| 2007/0031918 | A1 | 2/2007 | Dunson et al. |
| 2008/0182308 | A1 | 7/2008 | Donaldson et al. |
| 2008/0261230 | A1 | 10/2008 | Liao et al. |
| 2009/0081746 | A1 | 3/2009 | Liao et al. |
| 2009/0239275 | A1 | 9/2009 | Donaldson et al. |
| 2010/0081154 | A1 | 4/2010 | Flint et al. |
| 2010/0081179 | A1 | 4/2010 | Anthony et al. |
| 2010/0081182 | A1 | 4/2010 | Paul et al. |
| 2010/0093020 | A1 | 4/2010 | Bramucci et al. |
| 2010/0120105 | A1 | 5/2010 | Anthony et al. |
| 2010/0143997 | A1 | 6/2010 | Buelter et al. |
| 2011/0076733 | A1 | 3/2011 | Urano et al. |
| 2011/0124060 | A1 | 5/2011 | Anthony et al. |
| 2011/0136192 | A1 | 6/2011 | Paul et al. |
| 2011/0195505 | A1 | 8/2011 | Euler et al. |
| 2011/0244536 | A1 | 10/2011 | Nagarajan et al. |
| 2011/0250610 | A1 | 10/2011 | Bramucci et al. |
| 2011/0275129 | A1 | 11/2011 | Buelter et al. |
| 2012/0058541 | A1 | 3/2012 | Alsaker et al. |
| 2012/0064561 | A1 | 3/2012 | Flint et al. |
| 2012/0149080 | A1 | 6/2012 | Bramucci et al. |
| 2012/0196341 | A1 | 8/2012 | Donaldson et al. |
| 2012/0237988 | A1 | 9/2012 | Anthony et al. |
| 2012/0258873 | A1 | 10/2012 | Gibson et al. |
| 2013/0035515 | A1 | 2/2013 | Dobson et al. |
| 2013/0071898 | A1 | 3/2013 | Anthony et al. |
| 2013/0171706 | A1 | 7/2013 | Donaldson et al. |
| 2013/0203138 | A1 | 8/2013 | McElvain et al. |
| 2013/0252296 | A1 | 9/2013 | Maggio-Hall |
| 2013/0316414 | A1 | 11/2013 | Paul |
| 2014/0004526 | A1 | 1/2014 | Dauner et al. |
| 2014/0030782 | A1 | 1/2014 | Anthony et al. |
| 2014/0030783 | A1 | 1/2014 | Anthony et al. |
| 2014/0038263 | A1 | 2/2014 | Flint et al. |
| 2014/0038268 | A1 | 2/2014 | Flint et al. |
| 2014/0051133 | A1 | 2/2014 | Govindarajan et al. |
| 2014/0051137 | A1 | 2/2014 | Flint et al. |
| 2014/0057329 | A1 | 2/2014 | Li et al. |
| 2014/0093930 | A1 | 4/2014 | Li et al. |
| 2014/0096439 | A1 | 4/2014 | Bramucci et al. |
| 2014/0141479 | A1 | 5/2014 | Anthony et al. |
| 2014/0162333 | A1 | 6/2014 | Anthony et al. |
| 2014/0170732 | A1 | 6/2014 | Bramucci et al. |
| 2014/0186910 | A1 | 7/2014 | Rothman et al. |
| 2014/0186911 | A1 | 7/2014 | Anthony et al. |

FOREIGN PATENT DOCUMENTS

| | | |
|---|---|---|
| WO | WO0112833 | 2/2001 |
| WO | WO2005040392 | 5/2005 |
| WO | WO2008098227 | 8/2008 |
| WO | WO2008130995 | 10/2008 |
| WO | WO2009056984 | 5/2009 |
| WO | WO2009059253 | 5/2009 |
| WO | WO2009078108 | 6/2009 |
| WO | WO2009086423 | 7/2009 |
| WO | WO2010051527 | 5/2010 |
| WO | WO2011159853 | 12/2011 |
| WO | WO2011159894 | 12/2011 |
| WO | WO2012033832 | 3/2012 |
| WO | WO2012129555 | 9/2012 |

OTHER PUBLICATIONS van der Geize, et al., Targeted Disruption of the kstD Gene Encoding a 3-Ketosteriod delta1-Dehydrogenase Isoenzyme of Rhodococcus erythropolis Strain SQ1, Appl. Environ. Microbiol. 66:2029-2036, 2000.
Chunduru, et al., Mechanism of Ketol Acid Reductoisomerase—Steady State Analysis and Metal Ion Requirement, Biochemistry 28:486-493 1989.
de Cavalho, et al., *Mycobacterium* sp., *Rhodococcus erythropolis*, and *Pseudomonas putida* Behavior in the Presence of Organic Solvents, Microsc. Res. Tech. 64:215-22, 2004.
de la Plaza, et al., Biochemical and molecular characterization of alpha-ketoisovalerate decarboxylase, an enzyme involved in the formation of aldehydes from amino acids by Lactococcus lactis, FEMS Microbiol. Lett. 238:367-374, 2004.
Deshpande, Ethanol Production from Cellulose by Coupled Saccharification/Fermentation using *Saccharomyces cerevisiae* and Cellulase Complex from Sclerotium rolfsii UV-8 Mutant, Appl. Biochem. Biotechnol. 36:227, 1992.
Dürre, et al., Solventogenic Enzymes of Clostridium acetobutylicum: Catalytic Properties, Genetic Organization, and Transcriptional Regulation, FEMS Microbiol. Rev. 17:251-262, 1995.
Dürre, New insights and novel developments in clostridial acetone/butanol/isopropanol fermentationAppl. Microbiol. Biotechnol. 49:639-648, 1998.
Eichenbaum, et al., Use of the Lactococcal nisA Promoter To Regulate Gene Expression in Gram-Positive Bacteria: Comparison of Induction Level and Promoter Strength, Appl. Environ. Microbiol. 64:2763-2769, 1998.
Fleming, et al., Extracellular Enzyme Synthesis in a Sporulation-Deficient Strain of Bacillus licheniformis, Appl. Environ. Microbiol. 61:3775-3780, 1995.
Flint, et al., The Role and Properties of the Iron-Sulfur Cluster in *Escherichia coli* Dihydroxy-acid Dehydratase, J. Biol. Chem. 268:14732-14742, 1993.
Ford, et al., Characterization of Yprlp from *Saccharomyces cerevisiae* as a 2-methylbutyraldehyde reductase, Yeast 19:1087-1096, 2002.
Fujimoto, et al., pAM401-Based Shuttle Vectors That Enable Overexpression of Promoterless Genes and One-Step Purification of Tag Fusion Proteins Directly from Enterococcus faecalis, Appl. Environ. Microbiol. 67:1262-1267, 2001.
Gollop, et al., Physiological Implications of the Substrate Specificities of Acetohydroxy Acid Synthases from Varied Organisms, J. Bacteriol. 172:3444-3449, 1990.
Groot, et al., Technologies for Butanol Recovery Integrated with Fermentations, Process. Biochem. 27:61-75, 1992.
Guex, et al., Swiss-Model and the Swiss-PdbViewer: An Environment for Comparative Protein Modeling, Electrophoresis 18:2714-2723, 1997.
Hermann, et al., Isolation and Characterization of Butanol-Resistant Mutants of Clostridium acetobutylicum, Appl. Environ. Microbiol. 50:1238-1243, 1985.
Holtzclaw, et al., Degradative Acetolactate Synthase of Bacillus subtilis: Purification and Properties, J. Bacteriol. 121:917-922, 1975.
Jones, et al., Improved Methods for Building Protein Models in Electron Density Maps and the Location of Errors in these Models, Acta Crystallogr. A 47:110-119, 1991.
Kabelitz, et al., Effect of aliphatic alcohols on growth and degree of saturation of membrane lipids in Acinetobacter calcoaceticus, FEMS Microbiol. Lett. 220: 223-227, 2003.
Datsenko, et al., One-step inactivation of chromosomal genes in *Escherichia coli* K-12 using PCR products, Proc. Natl. Acad. Sci. USA 97:6640-6645, 2000.
Kleerebezem, et al., Controlled Gene Expression Systems for Lactic Acid Bacteria: Transferable Nisin-Inducible Expression Cassettes for *Lactococcus, Leuconostoc,* and *Lactobacillus* spp., Appl. Environ. Microbiol. 63:4581-4584, 1997.
Kostichka, et al., A small cryptic plasmid from Rhodococcus erythropolis : characterization and utility for gene expressionAppl. Microbiol. Biotechnol. 62:61-68, 2003.
Krogh, et al., Hidden Markov Models in Computational Biology, J. Mol. Biol. 235:1501-1531, 1994.
Larroy, et al., Characterization of the *Saccharomyces cerevisiae* YMR318C (ADH6) gene product as a broad specificity NADPH-dependent alcohol dehydrogenase: relevance in aldehyde reduction, Biochem. J. 361:163-172, 2002.
Maguin, et al., New Termosensitive Plasmid for Gram-Positive Bacteria, J. Bacteriol. 174:5633-5638, 1992.

(56) References Cited

OTHER PUBLICATIONS

Marinus, et al., Regulation of Isoleucine-Valine Biosynthesis in Pseudomonas aeruginosa, Genetics 63:547-56, 1969.

Nagarajan, et al., Modular Expression and Secretion Vectors for Bacillus subtilis, Gene 114:121-126, 1992.

Nakashima, et al., Isolation and Characterization of Rolling-Circle-Type Plasmid from Rhodococcus erythropolis and Application of the Plasmid to Multiple-Recombinant-Protein Expression, Appl. Environ. Microbiol. 70:5557-5568, 2004.

Nallaapareddy, et al., Construction of Improved Temperature-Sensitive and Mobilizable Vectors and Their Use for Constructing Mutations in the Adhesin-Encoding acm Gene of Poorly Transformable Clinical Enterococcus faecium Strains, Appl. Environ. Microbiol. 72:334-345, 2006.

O'Sullivan, et al., High- and low-copy-number Lactococcus shuttle cloning vectors with features for clone screening, Gene 137:227-231, 1993.

Payne, et al., Use of Alkaline Phosphatase Fusions to Study Protein Secretion in Bacillus subtilis, J. Bacteriol. 173:2278-2282, 1991.

Renault, et al., Plasmid Vectors for Gram-positive Bacteria Swithching from High to Low Copy Number, Gene 183:175-182, 1996.

Scott, et al., Sequences of versatile broad-host-range vectors of the RK2 family, Plasmid 50:74-79, 2003.

Smit, et al., Identification, Cloning, and Characterization of a Lactococcus lactis Branched-Chain alpha-Keto Acid Decarboxylase Involved in Flavor Formation, Appl. Environ. Microbiol. 71:303-311, 2005.

Sulter, et al., Proliferation and metabolic significance of peroxisomes in Candida boidinii during drowth on D-alanine or oleic acid as the sole carbon source, Arch. Microbiol. 153:485 489, 1990.

Sulzenbacher, et al., Crystal Structure of E. coli Alcohol Dehydrogenase YqhD: Evidence of a Covalently Modified NADP Coenzyme, J. Mol. Biol. 342:489-502, 2004.

Tabor, et al., A bacteriophage T7 RNA polymerase/promoter system for controlled exclusive expression of specific genes, Proc. Acad. Sci. USA 82:1074, 1985.

Taghavi, et al., Electroporation of Alcaligenes eutrophus with (Mega) Plasmids and Genomic DNA Fragments, Appl. Environ. Microbiol. 60:3585-3591, 1994.

Tanimoto, et al., Analysis of the Conjugal Transfer System of the Pheromone-Independent Highly Transferable Enterococcus Plasmid pMG1: Identification of a tra Gene (traA) Up-Regulated during Conjugation, J. Bacteriol. 184:5800-5804, 2002.

Tao, et al., Construction of highly efficient E. coli expression systems containing low oxygen induced promoter and partition region, Appl. Microbiol. Biotechnol. 68:346-354, 2005.

Thompson, et al., Clustal W: improving the sensitivity of progressive multiple sequence alignment through sequence weighting, position-specific gap penalties and weight matrix choice, Nuc. Acid Res. 22:4673-4680, 1994.

Tomas, et al., Transcriptional Analysis of Butanol Stress and Tolerance in Clostridium acetobutylicum, J. Bacteriol. 186:2006-2018, 2004.

Tyagi, et al., The crystal structure of a bacterial Class II ketol-acid reductoisomerase: Domain conservation and evolution, Protein Sci. 14:3089-3100, 2005.

van Kranenburg, et al., Functional Analysis of Three Plasmids from Lactobacillus plantarum, Appl. Environ. Microbiol. 71:1223-1230, 2005.

Walker, et al., Isothermal in vitro amplification of DNA by a restriction enzyme/DNA polymerase systemProc. Natl. Acad. Sci. U.S.A. 89:392-396, 1992.

Wyckoff, et al., Characterization and Sequence Analysis of a Stable Cryptic Plasmid from Enterococcus faecium 226 and Development of a Stable Cloning Vector, Appl. Environ. Microbiol. 62:1481-1486, 1996.

Dumas, et al., Purification and characterization of a fusion protein of plant acetohydroxy acid synthase and acetohydroxy acid isomeroreductase, FEBS Lett. 408:156-160, 1997.

Bellion et al., Microb. Growth C1 Compd., [Int. Symp.], 7th (1993), 415 32. (eds): Murrell, J. Collin; Kelly, Don P. Publisher: Intercept, Andover, UK.

Dumas, et al., Isolation and kinetic properties of acetohydroxy acid isomeroreductase from spinach (*Spinacia oleracea*) chloroplasts overexpressed in *Escherichia coli*, Biochem. J. 288:865-874, 1992.

Epelbaum, et al. Branched-chain amino acid biosynthesis in *Salmonella typhimurium*: a quantitative analysis, J. Bacteriol. 180:4056-4067, 1998.

Kuzuyama, Mevalonate and nonmevalonate pathways for the biosynthese of isoprene unites, Biosci. Biotechnol. Biochem. 66:1619-1627, 2002.

Garcia, et al. Fusel alcohols production in beer fermentation processes, Proc. Biochem. 29:303-309,1994.

Carlini, et al., Guerbet condensation of methanol with n-propanol to isobutyl alcohol over heterogeneous copper chromite/Mg—Al mixed oxides, J. Mol. Catalysis A 220:215-220, 2004.

Rothstein, Targeting, disruption, replacement, and allele rescue: integrative DNA transformation in yeast, Meth. Enzymol. 194:281-301, 1991.

Horton, et al., Engineering hybrid genes without the use of restriction enzymes: gene splicing by overlap extension, Gene 77:61-68, 1989.

Kaneko, et al., Complete Genome Sequence of the Filamentous Nitrogen-fixing *Cyanobacterium anabaena* sp. strain PCC 7120, DNA Res. 8:205-213, 227-253, 2001.

Dickinson, et al., An Investigation of the Metabolism to Isobutyl Alcohol in *Saccharomyces cerevisiae*, J. Biol. Chem. 273:25752-25756, 1998.

Oaxaca, et al., Formation of Ethanol and Higher Alcohols by Immobilized Zymomonas mobilis in Continuous Culture, ACTA Biotechnol. 11:523-532, 1991.

Eppink, et al., Switch of Coenzyme Specificity of p-Hydroxybenzoate Hydroxylase, J. Mol. Biol. 292:87-96, 1999.

Nakanishi, et al., Switch of Coenzyme Specificity of Mouse Lung Carbonyl Reductase by Substitution of Threonine 38 with Aspartic Acid, J. Biol. Chem. 272:2218-2222, 1997.

Kamerbeek, et al., Identifying Determinants of NADPH Specificity in Baeyer-Villiger Monooxygenases, Eur. J. Biochem. 271:2107-2116, 2004.

Nishiyama, et al., Alteration of Coenzyme Specificity of Malate Dehydrogenase from Thermus flavus by Site-directed Mutagenesis, J. Biol. Chem. 268:4656-4660, 1993.

Martinez-Julvez, et al., Towards a New Interaction Enzyme: Coenzyme, Biophys. Chem. 115:219-224, 2005.

Rane, et al., Reversal of the Nucleotide Specificity of Ketol Acid Reductoisomerase by Site-Directed Mutagenesis Identifies the NADPH Binding Site, Archiv. Biochem. Biophys. 338:83-89, 1997.

Ahn, et al., Crystal Structure of Class I Acetohydroxy Acid Isomeroreductase from Pseudomonas aeruginosa, J. Mol. Biol. 328:505-515, 2003.

Paulsen, et al., Complete genome sequence of the plant commensal Pseudomonas fluorescens Pf-5, Nature Biotechnol. 23:8730878, 2005.

Carugo, et al., NADP-Dependent Enzymes I: Conserved Stereochemistry of Cofactor Binding, Proteins: Structure, Function, and Genetics 28:10-28, 1997.

Dumas, et al., Enzymology, Structure, and Dynamics of Acetohydroxy Acid Isomeroreductase, Acc. Chem. Res. 34:399-408, 2001.

Emore, et al., Modification of the Nucleotide Cofactor-binding Site of Cytochrome P-450 Reductase to Enhance Turnover with NADH in vivo, J. Biol. Chem. 277:48960-48964, 2002.

Fisher, et al., The X-ray Structure of Brassica napus beta-keto acyl carrier protein reductase and its implication for substrate binding and catalysis, Structure 8:339-347, 2000.

Khoury, et al., Computational design of Candida boidinii xylose reductase for altered cofactor specificity, Protein Sci. 18:2125-2136, 2009.

Kuzuyama, et al., Characterization of 1-deoxy-D-xylulose 5-Phosphate Reductoisomerase, an Enzyme Involved in Isopentenyl Diphosphate Biosynthesis, and Identification of Its Catalytic Amino Acid Residues, J. Biol. Chem. 275:19928-19932, 2000.

(56) References Cited

OTHER PUBLICATIONS

Medina, et al., Probing the Determinants of Coenzyme Specificity in Ferredoxin-NADP+ Reductase by Site-directed Mutagenesis, J. Biol. Chem. 276:11902-11912, 2001.
Wierenga, et al., Prediction of the Occurence of the SDP-binding Beta-alpha-beta Fold in Proteins, Using an Amino Acid Sequence Fingerprint, J. Mol. Biol. 187:101-107, 1986.
Brinkmann-Chen, et al., General approach to reversing ketol-acid reductoisomerase cofactor dependence from NADPH to NADH, Proc. Natl. Acad. Sci. 110:10946-10951, 2013.
Rossmann, et al., Chemical and biological evolution of nucleotide-binding protein, Nature 250:194-199, 1974.
Curien, et al., Nucleotide sequence and characterization of a cDNA encoding the acetohydroxy acid isomeroreductase from Arabidopsis thaliana, Plant Molecular Biology 21:717-722, 1993.
Dumas, et al., Purification and characterization of acetohydroxyacid reductoisomerase from spinach chloroplasts, Biochem. J. 262:971-976, 1989.
Durner, et al., Ketol-Acid Reductoisomerase from Barley (*Hordeum vulgare*): Purification, Properties, and Specific Inhibition, Plant Physiol. 103:903-910, 1993.
Feeney, et al., A single amino acid substitution in lactate dehydrogenase improves the catalytic efficiency with an alternative coenzyme, Biochem. Biophys. Res. Commun. 166:667-672, 1990.
Inui, et al., Identification and sequence determination of the acetohydroxy acid isomeroreductase gene from Brevibacterium flavum MJ233, DNA Seq. 4:95-103, 1993 (Abstract).
Lauvergeat, et al., Site-directed mutagenesis of a serine residue in cinnamyl alcohol dehydrogenase, a plant NADPH-dependent dehydrogenase, affects the specificity for the coenzyme, Biochemistry 34:12426-12434, 1995.
Levskaya, et al., Synthetic biology: engineering *Escherichia coli* to see light, Nature 438:441-442, 2005.
Shiraishi, et al., Engineering of pyridine nucleotide specificity of nitrate reductase: mutagenesis of recombinant cytochrome b reductase fragment of Neurospora crassa NADPH:Nitrate reductase, Archives of Biochemistry and Biophysics 358:104-115, 1998.
Tyagi, et al., Probing the mechanism of the bifunctional enzyme ketol-acid reducoisomerase by site-directed mutagensis of the active site, FEBS Journal 272:593-602, 2005.
Zhang, et al., Change of nucleotide specificity and enhancement of catalytic efficiency in single point mutants of Vibrio harveyi aldehyde dehydrogenase, Biochemistry 38:11440-11447, 1999.
International Search Report dated Mar. 20, 2014 for corresponding International Application No. PCT/US2013/062040.
UniProt_B0MCX7, keto-acid reductoisomerase, Anaerostipes caccae DSM 14662, Apr. 8, 2008.
EBI Accession No. UniProt: Q8ZAC2, Entry Date Jun. 6, 2003.
EBI Accession No. UniProt: Q0AV19, Entry Date Jan. 15, 2008.
EBI Accession No. UniProt: Q02138, Entry Date Jul. 1, 1993.
EBI Accession No. UniProt: Q01292, Entry Date Apr. 1, 1993.
EBI Accession No. UniProt: P06168, Entry Date Jan. 1, 1988.
EBI Accession No. UniProt: P05793, Entry Date Nov. 1, 1988.
EBI Accession No. UniProt: B1ZV88, Entry Date Jun. 6, 2003.
She, et al., Q97YJ9—UNIPROTKB/Swiss-Prot. Database, Oct. 31, 2006.
Suerbaum, et al., UniProtKB Database, Accession Q7VGW6, 2003.
Kaneko, et al., Q8YUM—UniProt Database, Mar. 23, 2010.
GenBank No. NC_009135.1, Methanococcus maripaludis C5, complete genome, Apr. 30, 2009.
GenBank No. NC_005791.1, Methanococcus maripaludis S2, complete genome, Apr. 25, 2009.
GenBank No. NZ_AAWX01000002.1, Copeland, et al., Feb. 7, 2007; pp. 1-3.
GenBank No. NC_001144.4, *Saccharomyces cerevisiae* chromosome XII, complete sequence, Jun. 16, 2008.
GenBank No. NC_002754.1, Sulfolobus solfataricus P2, complete genome, Apr. 26, 2009.
GenBank No. NC_003364.1, Pyrobaculum aerophilum str. IM2, complete genome, Apr. 24, 2009.
GenBank No. AAA25079, acetolactate synthase [Klebsiella pneumoniae], Aug. 5, 1994.
GenBank No. AAA25161, alpha-acetolactate synthase, Apr. 21, 1994.
GenBank No. AAA65614, keto acid dehydrogenase E1-alpha subunit [Pseudomonas putida] Feb. 27, 2002.
GenBank No. AAA65615, 39 kDa keto acid dehydrogenase E1-beta subunit [Pseudomonas putida], Feb. 27, 2002.
GenBank No. AAA65617, transacylase E2 [Pseudomonas putida], Feb. 27, 2002.
GenBank No. AAA65618, lipoamide dehydrogenase [Pseudomonas putida], Feb. 27, 2002.
GenBank No. AAS49166, branched-chain alpha-ketoacid decarboxylase [Lactococcus lactis], Dec. 27, 2004.
GenBank No. AJ746364, *Lactococcus lactis* subsp. *lactis* kivd gene for alpha-ketoisovalerate decarboxylase, strain IFPL730, Apr. 15, 2005.
GenBank No. AY548760, Lactococcus lactis branched-chain alpha-ketoacid decarboxylase (kdcA) gene, complete ods, Dec. 27, 2004.
GenBank No. BX950229, Methanococcus maripaludis strain S2, complete sequence, May 8, 2008.
GenBank No. CAB14105, dihydroxy-acid dehydratase [*Bacillus subtilis* subsp. *subtilis* str, Oct. 1, 2009.
GenBank No. CAB14334, branched-chain alpha-keto acid dehydrogenase E2 subunit (lipoamide acyltransferase) [*Bacillus subtilis* subsp. *subtilis* str. 168] Oct. 1, 2009.
GenBank No. CAB14335, branched-chain alpha-keto acid dehydrogenase E1 subunit [*Bacillus subtilis* subsp. *subtilis* str. 168], Oct. 1, 2009.
GenBank No. CAB14336, branched-chain alpha-keto acid dehydrogenase E1 subunit [*Bacillus subtilis* subsp. *subtilis* str. 168], Oct. 1, 2009.
GenBank No. CAB14337, branched-chain alpha-keto acid dehydrogenase E3 subunit (dihydrolipoamide dehydrogenase) [*Bacillus subtilis* subsp. *subtilis* str. 168], Oct. 1, 2009.
GenBank No. CAB15618, alpha-acetolactate synthase [*Bacillus subtilis* subsp. *subtilis* str. 168], Oct. 1, 2009.
GenBank No. CAF29874, Dihydroxy-acid dehydratase [Methanococcus maripaludis S2], May 8, 2008.
GenBank No. CAG34226, alpha-ketoisovalerate decarboxylase [*Lactococcus lactis* subsp. *lactis*], Apr. 15, 2005.
GenBank No. L16975, Lactococcus lactis alpha-acetolactate synthase (als) gene, complete cds, Apr. 21, 1994.
GenBank No. M57613, Pseudomonas putida branched-chain keto acid dehydrogenase operon (bkdA1, bkdA1 and bkdA2), transacylase E2 (bkdB), bkdR and lipoamide dehydrogenase (lpdV) genes, complete cds. Feb. 27, 2002.
GenBank No. M73842, Klebsiella pneumoniae acetolactate synthase (iluk) gene, complete cds, Aug. 5, 1994.
GenBank No. NC_001142, Nosema ceranae BRL01 Nc001142, whole genome shotgun sequence, Jun. 9, 2009.
GenBank No. NC_003030, Clostridium acetobutylicum ATCC 824, complete genome, Oct. 22, 2009.
GenBank No. NC_001136, *Saccharomyces cerevisiae* chromosome IV, complete sequence, Dec. 9, 2009.
GenBank No. NC_001145, *Saccharomyces cerevisiae* chromosome XIII, complete sequence, Dec. 9, 2009.
GenBank No. NC_001988, Clostridium acetobutylicum ATCC 824 plasmid pSOL1, complete sequence, Apr. 26, 2009.
GenBank No. NC_003197, *Salmonella typhimurium* LT2, complete genome, Mar. 30, 2010.
GenBank No. NP_012550, Dihydroxyacid dehydratase, catalyzes third step in the common pathway leading to biosynthesis of branchedchain amino acids; Ilv3p [*Saccharoymyces cerevisiae*], Nov. 5, 2009.
GenBank No. NP_010656, Jacq, et al., downloaded Apr. 15, 2010, pp. 1-3.
GenBank No. NP_014051, Adh6p [*Saccharomyces cerevisiae*], Dec. 9, 2009.
GenBank No. NP_149189, pyruvate decarboxylase [Clostridium acetobutylicum ATCC 824], Apr. 26, 2009.

(56) References Cited

OTHER PUBLICATIONS

GenBank No. NP_349892, NADH-dependent butanol dehydrogenase A (BDH I) [Clostridium acetobutylicum ATCC 824], Apr. 14, 2010.
GenBank No. NP_417484, alcohol dehydrogenase, NAD(P)-dependent [*Escherichia coli* str. K-12 substr. MG1655], Apr. 9, 2010.
GenBank No. NP_461346, indolepyruvate decarboxylase [*Salmonella typhimurium* LT2], Apr. 30, 2009.
GenBank No. YP_026248, dihydroxyacid dehydratase [*Escherichia coli* str. K-12 substr. MG1655], Jul. 30, 2009.
GenBank No. Z99115, Bacillus subtilis complete genome (section 12 of 21): from 2207806 to 2409180, Nov. 15, 2007.
GenBank No. AL009126, *Bacillus subtilis* subsp. *subtilis* str. 168 complete genome, Oct. 1, 2009.
GenBank No. Z99122, Bacillus subtilis complete genome (section 19 of 21): from 3608981 to 3809670, Apr. 18, 2005.
GenBank No. ZP01224863.1, ketol-acid reductoisomerase [marine gamma proteobacterium HTCC2207], Mar. 24, 2006.
GenBank No. NC_003295.1, Ralstonia solanacearum GMI1000, complete genome, May 1, 2009.
GenBank No. NC_002516, Pseudomonas aeruginosa PAO1, Jul. 20, 2008.
GenBank No. NC_004129, Pseudomonas fluorescens Pf-5, Jul. 20, 2008.
GenBank No. ZP_01313517.1, ketol-acid reductoisomerase [Desulfuromonas acetoxidans DSM 684], May 15, 2006.
GenBank No. O82043, Ketol-acid reductoisomerase, chloroplastic, Jun. 16, 2009.
GenBank No. NP_977840.1, ketol-acid reductoisomerase [Bacillus cereus ATCC 10987], May 1, 2009.
GenBank No. NP_978252.1, ketol-acid reductoisomerase [Bacillus cereus ATCC 10987], May 1, 2009.
GenBank No. P05793, Daniels, et al., Jun. 16, 2009; pp. 1-9.
Entrez GenBank Accession No. UNIPROT: Q6F821, Barbe, et al., Oct. 2004; pp. 1-2.
GenBank Accession No. Q4K608, ketol-acid reductoisomerase, Pseudomonas fluorescens, Aug. 2, 2005, viewed Nov. 14, 2008.
GenBank EDR97797.1 Feb. 12, 2008. 1 page.
Kumanovics, et al., Identification of FRA 1 and FRA2 as genes involved in regulating the yeast iron regulon in response to decreased mitochondrial iron-sulfur cluster synthesis. J. Biol. Chem. 283:10276-10286, 2008.
Davison, et al. Continuous Direct Solvent Extration of Butanol in a Fermenting Fluidized-Bed Bioreactor with Immobilized Clostridium acetobutylicum. Appl. Biochem. Biotech. 39/40:415-426, 1993.
Altschul, et al., Basic Local Alignment Search Tool, J. Mol. Biol. 215:403-410, 1990.
Spano, et al., Environmental stress response in wine lactic acid bacteria: beyond Bacillus subtilis, Crit. Rev. Microbiol. 32:77-86, 2006.
Chang, et al., Construction and Characterization of Amplifiable Multicopy DNA Cloning Vehicles Derived from the P15A Cryptic Miniplasmid, J. Bacteriol. 134:1141-1156, 1978.
Ferain, et al., Lactobacillus plantarum IdhL gene: overexpression and deletion, J. Bacteriol. 176:596-601, 1994.
Godon. et al., Branched-chain amino acid biosynthesis genes in *Lactococcus lactic* subsp. *lactis*, J. Bacteriol. 174:6580-6589, 1992.
Horinouchi, et al., Nucleotide sequence and functional map of pE194, a plasmid that specifies inducible resistance to macrolide, lincosamide, and streptogramin type B antibiotics, J. Bacteriol. 150:804-814, 1982.
Higgins, et al., CLUSTAL V: improved software for multiple sequence alignment, CABIOS 8:189-191, 1992.
Higgins et al., Fast and sensitive multiple sequence alignments on a microcomputer, CABIOS Communications 5:151-153, 1989.
Johnson, et al., DNA sequences at the ends of transposon Tn5 required for transposition, Nature 304:280-282, 1983.
Rud, et al., A synthetic promoter library for constitutive gene expression in lactobacillus plantarum, Microbiol. 152:1011-1019, 2006.
Yansura, et al., Use of the *Escherichia coli* lac repressor and operator to control gene expression in Bacillus subtilis, Proc. Natl. Acad. Sci. USA, vol. 81:439-443, 1984.
Yuan, et al., Regulation of groE Expression In Bacillus subtilis: the Involvement of the cr -Like Promoter and the Roles of the Inverted Sequence (CIRCE), J. Bacteriol. 177: 5427-5433, 1995.
Pearson, Comput. Methods Genome Res., [Proc. Int. Symp.] (1994), Meeting Date 1992, 111-20. Editor(s): Suhai, Sandor. Plenum: New York, NY.
Vasantha, et al., Genes for Alkaline Protease and Neutral Protease from Bacillus amyloliquefaciens Contain a Large Open Reading Frame Between the Regions Coding for Signal Sequence and Mature Protein, J. Bacteriol., 159:811-819, 1984.
Methods in Yeast Genetics, 2005, Cold Spring Harbor Laboratory Press, Cold Spring Harbor, NY, pp. 201-202.
Butanols, Ullman's Encyclopedia of Industrial Chemistry, 6th Edition, 5:716-719, 2003.
GenBank Accession No. NC_V002505, Vibrio cholerae O1 biovar eltor str. N16961, Jul. 21, 2008.
GenBank Accession No. AAU36450, Psuedomonas aeruginosa cellular proliferation protein, Feb. 14, 2002, viewed Nov. 14, 2008.
GenBank Accession No. A3EGY6, ketol-acid reductoisomerase. Vibrio chlorea, Mar. 20, 2007, viewed Nov. 14, 2008.
GenBank Accession No. NC_000913, *Escherichia coli* str. K-12 substr. MG1655, May 17, 2008.
GenBank Accession No. B9CVH4, viewed Feb. 8, 2011.
GenBank Accession No. YP_162876, ketol-acid reductoisomerase [*Zymomonas mobilis* subsp. *mobilis* ZM4 = ATCC 31821], Jun. 10, 2013.
GenBank Accession No. ZP_07930881, ketol-acid reductoisomerase [*Anaerostipes* sp. 3_2_56FAA] Nov. 27, 2012.

POLYPEPTIDES WITH KETOL-ACID REDUCTOISOMERASE ACTIVITY

CROSS-REFERENCE TO RELATED APPLICATIONS

This application is related to and claims the benefit of priority of U.S. Provisional Application Ser. No. 61/705,977 filed on Sep. 26, 2012, the entirety of which is herein incorporated herein by reference.

REFERENCE TO SEQUENCE LISTING SUBMITTED ELECTRONICALLY

The content of the electronically submitted sequence listing in ASCII text file (Name: 20130926_CL5862USNP_SeqList.txt, Size: 1,035,350 bytes, and Date of Creation: Sep. 26, 2013) filed with the application is incorporated herein by reference in its entirety.

FIELD OF THE INVENTION

The invention relates to polypeptides having ketol-acid reductoisomerase activity suited for performance in isobutanol production pathways.

BACKGROUND OF THE INVENTION

Ketol-acid reductoisomerase (KARI) enzymes are involved in the biological production of valine and isoleucine. KARI enzymes have also been shown to be useful for pathways for the production of isobutanol using engineered microorganisms (U.S. Pat. Nos. 7,851,188 and 7,993,889). Such microorganisms can be used to produce isobutanol from plant-derived substrates.

While methods for the chemical synthesis of isobutanol are known (oxo synthesis, catalytic hydrogenation of carbon monoxide (Ullmann's Encyclopedia of Industrial Chemistry, 6th edition, 2003, Wiley-VCH Verlag GmbH and Co., Weinheim, Germany, Vol. 5, pp. 716-719) and Guerbet condensation of methanol with n-propanol (Carlini et al., J. Molec. Catal. A. Chem. 220:215-220, 2004)), these processes use starting materials derived from petrochemicals and are generally expensive. Furthermore, chemical synthesis of isobutanol does not have the potential for environmental advantages such as minimization of green house gas emissions. Production of isobutanol from plant-derived raw materials would represent an advance in the art.

A KARI enzyme that can utilize reduced nicotinamide adenine dinucleotide (NADH) can capitalize on the NADH produced by the existing glycolytic pathway and other metabolic pathways in commonly used microbial cells and may result in improved isobutanol production. U.S. Pat. No. 8,129,162 and US Appl. Pub. No. 2010/0197519A1 and U.S. application Ser. No. 13/428,585, filed Mar. 23, 2012 (published as US Appln. Pub. No. 20130071898A1), each of which is incorporated herein by reference, describe the generation of KARI enzymes with varying abilities to utilize the cofactor (NADH). However, there remains a need in the art for alternative polypeptides that have KARI activity suitable for production pathways such as isobutanol biosynthetic pathways.

SUMMARY OF THE INVENTION

Provided herein are recombinant host cells comprising an isobutanol biosynthetic pathway and a) a heterologous polypeptide with ketol-acid reductoisomerase activity having at least about 85%, at least about 90% identity, at least about 95%, or at least about 98% identity to one of the following: K9JM2 (SEQ ID NO: 193), K9JM3 (SEQ ID NO: 194), K9JM4 (SEQ ID NO: 195), K9JM5 (SEQ ID NO: 196), K9JM6 (SEQ ID NO: 197), K9JM7 (SEQ ID NO: 198), K9JM8 (SEQ ID NO: 199), K9JM9 (SEQ ID NO: 200), K9JM10 (SEQ ID NO: 201), K9JM11 (SEQ ID NO: 202), K9JM12 (SEQ ID NO: 203), K9JM13 (SEQ ID NO: 204), K9JM14 (SEQ ID NO: 205), K9JM15 (SEQ ID NO: 206), K9JM16 (SEQ ID NO: 207), K9JM17 (SEQ ID NO: 208), K9JM18 (SEQ ID NO: 209), K9JM19 (SEQ ID NO: 210), K9JM20 (SEQ ID NO: 211), K9JM21 (SEQ ID NO: 212), K9JM22 (SEQ ID NO: 213), K9JM23 (SEQ ID NO: 214), K9JM24 (SEQ ID NO: 215), K9JM25 (SEQ ID NO: 216), K9JM26 (SEQ ID NO: 217), K9JM27 (SEQ ID NO: 218), K9JM28 (SEQ ID NO: 219), K9JM29 (SEQ ID NO: 220), K9JM30 (SEQ ID NO: 221), K9JM31 (SEQ ID NO: 222), JM32 (SEQ ID NO: 223), JM33 (SEQ ID NO: 224), JM34 (SEQ ID NO: 225), JM35 (SEQ ID NO: 226), JM36 (SEQ ID NO: 227), JM37 (SEQ ID NO: 228), JM38 (SEQ ID NO: 229), JM39 (SEQ ID NO: 230), JM40 (SEQ ID NO: 231), JM42 (SEQ ID NO: 232), JM43 (SEQ ID NO: 233), JM44 (SEQ ID NO: 234), K9_DAVID_SH (SEQ ID NO: 236), K9ALL3 (SEQ ID NO: 237), K9_URSALA (K9SB2+A56V) (SEQ ID NO: 239), JM41 (SEQ ID NO: 240), K9ALL148 (SEQ ID NO: 241), K9JM148 (SEQ ID NO: 242), K9ALL156 (SEQ ID NO: 243), K9JM156 (SEQ ID NO: 244), K9ALL191 (SEQ ID NO: 245), K9JM191 (SEQ ID NO: 246), K9ALL254 (SEQ ID NO: 247), K9ALL278 (SEQ ID NO: 248), K9ALL37 (SEQ ID NO: 249), K9JM37S (SEQ ID NO: 250), K9ALL66 (SEQ ID NO: 66), K9JM66 (SEQ ID NO: 252), K9ALL8Q (SEQ ID NO: 253), K9JM8Q (SEQ ID NO: 254), K9ALL45 (SEQ ID NO: 255), K9_LUCY (SEQ ID NO: 300), K9_ILYA (SEQ ID NO: 301), K9ALL258 (SEQ ID NO: 302), K9YW25-T191S (SEQ ID NO: 303), PLH689::ALL3 (SEQ ID NO: 304), F53L (SEQ ID NO: 307), F53I (SEQ ID NO: 308), F53M (SEQ ID NO: 309), F53V (SEQ ID NO: 310), F53P (SEQ ID NO: 311), F53S (SEQ ID NO: 312), F53A (SEQ ID NO: 313), F53E (SEQ ID NO: 314), F53Q (SEQ ID NO: 315), T11-1 (SEQ ID NO: 316), T11-2 (SEQ ID NO: 317), T11-3 (SEQ ID NO: 318), T11-4 (SEQ ID NO: 319), T11-5 (SEQ ID NO: 320), T11-6 (SEQ ID NO: 321), T11-7 (SEQ ID NO: 322), T11-10 (SEQ ID NO: 323), T11-12 (SEQ ID NO: 324), T11-13 (SEQ ID NO: 325), T11-14 (SEQ ID NO: 326), T11-15 (SEQ ID NO: 327), T11-16 (SEQ ID NO: 328), T11-18 (SEQ ID NO: 329), T11-19 (SEQ ID NO: 330), T11-21 (SEQ ID NO: 331), T11-22 (SEQ ID NO: 332), T11-25 (SEQ ID NO: 333), T11-27 (SEQ ID NO: 334), T11-28 (SEQ ID NO: 335), T11-29 (SEQ ID NO: 336), T11-30 (SEQ ID NO: 337), T11-32 (SEQ ID NO: 338), T11-33 (SEQ ID NO: 339), T11-35 (SEQ ID NO: 340), T11-36 (SEQ ID NO: 341), T11-37 (SEQ ID NO: 342), T11-38 (SEQ ID NO: 343), T11-39 (SEQ ID NO: 344), T11-42 (SEQ ID NO: 345), T11-43 (SEQ ID NO: 346), T11-44 (SEQ ID NO: 347), T11-45 (SEQ ID NO: 348), T11-46 (SEQ ID NO: 349), T11-47 (SEQ ID NO: 350), T11-49 (SEQ ID NO: 351), T11-50 (SEQ ID NO: 352), T11-52 (SEQ ID NO: 353), T11-54 (SEQ ID NO: 354), T11-55 (SEQ ID NO: 355), T11-56 (SEQ ID NO: 356), T11-57 (SEQ ID NO: 357), T11-58 (SEQ ID NO: 358), T11-59 (SEQ ID NO: 359), T11-60 (SEQ ID NO: 360), T11-61 (SEQ ID NO: 361), T11-62 (SEQ ID NO: 362), T11-64 (SEQ ID NO: 363), T11-66 (SEQ ID NO: 364), T11-67 (SEQ ID NO: 365), T11-69 (SEQ ID NO: 366), T11-70 (SEQ ID NO: 367), T11-72 (SEQ ID NO:

368), T11-74 (SEQ ID NO: 369), T11-75 (SEQ ID NO: 370), T11-76 (SEQ ID NO: 371), T11-79 (SEQ ID NO: 372), T11-80 (SEQ ID NO: 373), T11-81 (SEQ ID NO: 374), T11-83 (SEQ ID NO: 375), T11-84 (SEQ ID NO: 376), T11-85 (SEQ ID NO: 377), T11-86 (SEQ ID NO: 378), T11-87 (SEQ ID NO: 379), T11-88 (SEQ ID NO: 380), T11-91 (SEQ ID NO: 381), T11-94 (SEQ ID NO: 382), T11-95 (SEQ ID NO: 383), T11-96 (SEQ ID NO: 384), T11-97 (SEQ ID NO: 385), T11-99 (SEQ ID NO: 386), T11-103 (SEQ ID NO: 387), T11-104 (SEQ ID NO: 388), T11-109 (SEQ ID NO: 389), T11-110 (SEQ ID NO: 390), T11-111 (SEQ ID NO: 391), T11-114 (SEQ ID NO: 392), T11-116 (SEQ ID NO: 393), T11-117 (SEQ ID NO: 394), T11-119 (SEQ ID NO: 395), T11-121 (SEQ ID NO: 396), T11-122 (SEQ ID NO: 397), T11-124 (SEQ ID NO: 398), T11-125 (SEQ ID NO: 399), T11-128 (SEQ ID NO: 400), T11-130 (SEQ ID NO: 401), T11-131 (SEQ ID NO: 402), T11-134 (SEQ ID NO: 403), E147V (SEQ ID NO: 552), G164D (SEQ ID NO: 404), G304V (SEQ ID NO: 405), N258S (SEQ ID NO: 406), T71S (SEQ ID NO: 407), V184I (SEQ ID NO: 408), A279D (SEQ ID NO: 409), D98V (SEQ ID NO: 410), M169F (SEQ ID NO: 411), M169K (SEQ ID NO: 412), M169L (SEQ ID NO: 413), E100Q_M312K (SEQ ID NO: 414), ECB11 (SEQ ID NO: 534), EC2A2 (SEQ ID NO: 535), EC2B12 (SEQ ID NO: 536), EGC10 (SEQ ID NO: 537), EGD9 (SEQ ID NO: 538), EGG8 (SEQ ID NO: 539), EHG1 (SEQ ID NO: 540), EHG2 (SEQ ID NO: 541), EHH6 (SEQ ID NO: 520), EHH9 (SEQ ID NO: 521), EHH10 (SEQ ID NO: 522), EHH12 (SEQ ID NO: 523), EKC5 (SEQ ID NO: 546), EKG4 (SEQ ID NO: 547), EJF5 (SEQ ID NO: 548), EJB8 (SEQ ID NO: 549), EJA1 (SEQ ID NO: 550), EJB10 (SEQ ID NO: 551), K9_Lucy_SH (SEQ ID NO: 553), or K9JM1 (SEQ ID NO: 192) or an active fragment thereof; or b) a heterologous polynucleotide encoding the heterologous polypeptide of a).

Also provided herein are recombinant host cells comprising an isobutanol biosynthetic pathway and a) a heterologous polypeptide with ketol-acid reductoisomerase activity having at least about 90% identity, at least about 95% or at least about 98% identity to K9JM2 (SEQ ID NO: 193), K9JM3 (SEQ ID NO: 194), K9JM4 (SEQ ID NO: 195), K9JM5 (SEQ ID NO: 196), K9JM6 (SEQ ID NO: 197), K9JM7 (SEQ ID NO: 198), K9JM8 (SEQ ID NO: 199), K9JM9 (SEQ ID NO: 200), K9JM10 (SEQ ID NO: 201), K9JM11 (SEQ ID NO: 202), K9JM12 (SEQ ID NO: 203), K9JM13 (SEQ ID NO: 204), K9JM14 (SEQ ID NO: 205), K9JM15 (SEQ ID NO: 206), K9JM16 (SEQ ID NO: 207), K9JM17 (SEQ ID NO: 208), K9JM18 (SEQ ID NO: 209), K9JM19 (SEQ ID NO: 210), K9JM20 (SEQ ID NO: 211), K9JM21 (SEQ ID NO: 212), K9JM22 (SEQ ID NO: 213), K9JM23 (SEQ ID NO: 214), K9JM24 (SEQ ID NO: 215), K9JM25 (SEQ ID NO: 216), K9JM26 (SEQ ID NO: 217), K9JM27 (SEQ ID NO: 218), K9JM28 (SEQ ID NO: 219), K9JM29 (SEQ ID NO: 220), K9JM30 (SEQ ID NO: 221), K9JM31 (SEQ ID NO: 222), JM32 (SEQ ID NO: 223), JM33 (SEQ ID NO: 224), JM34 (SEQ ID NO: 225), JM35 (SEQ ID NO: 226), JM36 (SEQ ID NO: 227), JM37 (SEQ ID NO: 228), JM38 (SEQ ID NO: 229), JM39 (SEQ ID NO: 230), JM40 (SEQ ID NO: 231), JM42 (SEQ ID NO: 232), JM43 (SEQ ID NO: 233), JM44 (SEQ ID NO: 234), K9_DAVID_SH (SEQ ID NO: 236), K9ALL3 (SEQ ID NO: 237), K9_URSALA (K9SB2+A56V) (SEQ ID NO: 239), JM41 (SEQ ID NO: 240), K9ALL148 (SEQ ID NO: 241), K9JM148 (SEQ ID NO: 242), K9ALL156 (SEQ ID NO: 243), K9JM156 (SEQ ID NO: 244), K9ALL191 (SEQ ID NO: 245), K9JM191 (SEQ ID NO: 246), K9ALL254 (SEQ ID NO: 247), K9ALL278 (SEQ ID NO: 248), K9ALL37 (SEQ ID NO: 249), K9JM37S (SEQ ID NO: 250), K9ALL66 (SEQ ID NO: 66), K9JM66 (SEQ ID NO: 252), K9ALL8Q (SEQ ID NO: 253), K9JM8Q (SEQ ID NO: 254), K9ALL45 (SEQ ID NO: 255), K9_LUCY (SEQ ID NO: 300), K9_ILYA (SEQ ID NO: 301), K9ALL258 (SEQ ID NO: 302), K9YW25-T191S (SEQ ID NO: 303), F53L (SEQ ID NO: 307), F53I (SEQ ID NO: 308), F53M (SEQ ID NO: 309), F53V (SEQ ID NO: 310), F53P (SEQ ID NO: 311), F53S (SEQ ID NO: 312), F53A (SEQ ID NO: 313), F53E (SEQ ID NO: 314), F53Q (SEQ ID NO: 315), T11-1 (SEQ ID NO: 316), T11-2 (SEQ ID NO: 317), T11-3 (SEQ ID NO: 318), T11-4 (SEQ ID NO: 319), T11-5 (SEQ ID NO: 320), T11-6 (SEQ ID NO: 321), T11-7 (SEQ ID NO: 322), T11-10 (SEQ ID NO: 323), T11-12 (SEQ ID NO: 324), T11-13 (SEQ ID NO: 325), T11-14 (SEQ ID NO: 326), T11-15 (SEQ ID NO: 327), T11-16 (SEQ ID NO: 328), T11-18 (SEQ ID NO: 329), T11-19 (SEQ ID NO: 330), T11-21 (SEQ ID NO: 331), T11-22 (SEQ ID NO: 332), T11-25 (SEQ ID NO: 333), T11-27 (SEQ ID NO: 334), T11-28 (SEQ ID NO: 335), T11-29 (SEQ ID NO: 336), T11-30 (SEQ ID NO: 337), T11-32 (SEQ ID NO: 338), T11-33 (SEQ ID NO: 339), T11-35 (SEQ ID NO: 340), T11-36 (SEQ ID NO: 341), T11-37 (SEQ ID NO: 342), T11-38 (SEQ ID NO: 343), T11-39 (SEQ ID NO: 344), T11-42 (SEQ ID NO: 345), T11-43 (SEQ ID NO: 346), T11-44 (SEQ ID NO: 347), T11-45 (SEQ ID NO: 348), T11-46 (SEQ ID NO: 349), T11-47 (SEQ ID NO: 350), T11-49 (SEQ ID NO: 351), T11-50 (SEQ ID NO: 352), T11-52 (SEQ ID NO: 353), T11-54 (SEQ ID NO: 354), T11-55 (SEQ ID NO: 355), T11-56 (SEQ ID NO: 356), T11-57 (SEQ ID NO: 357), T11-58 (SEQ ID NO: 358), T11-59 (SEQ ID NO: 359), T11-60 (SEQ ID NO: 360), T11-61 (SEQ ID NO: 361), T11-62 (SEQ ID NO: 362), T11-64 (SEQ ID NO: 363), T11-66 (SEQ ID NO: 364), T11-67 (SEQ ID NO: 365), T11-69 (SEQ ID NO: 366), T11-70 (SEQ ID NO: 367), T11-72 (SEQ ID NO: 368), T11-74 (SEQ ID NO: 369), T11-75 (SEQ ID NO: 370), T11-76 (SEQ ID NO: 371), T11-79 (SEQ ID NO: 372), T11-80 (SEQ ID NO: 373), T11-81 (SEQ ID NO: 374), T11-83 (SEQ ID NO: 375), T11-84 (SEQ ID NO: 376), T11-85 (SEQ ID NO: 377), T11-86 (SEQ ID NO: 378), T11-87 (SEQ ID NO: 379), T11-88 (SEQ ID NO: 380), T11-91 (SEQ ID NO: 381), T11-94 (SEQ ID NO: 382), T11-95 (SEQ ID NO: 383), T11-96 (SEQ ID NO: 384), T11-97 (SEQ ID NO: 385), T11-99 (SEQ ID NO: 386), T11-103 (SEQ ID NO: 387), T11-104 (SEQ ID NO: 388), T11-109 (SEQ ID NO: 389), T11-110 (SEQ ID NO: 390), T11-111 (SEQ ID NO: 391), T11-114 (SEQ ID NO: 392), T11-116 (SEQ ID NO: 393), T11-117 (SEQ ID NO: 394), T11-119 (SEQ ID NO: 395), T11-121 (SEQ ID NO: 396), T11-122 (SEQ ID NO: 397), T11-124 (SEQ ID NO: 398), T11-125 (SEQ ID NO: 399), T11-128 (SEQ ID NO: 400), T11-130 (SEQ ID NO: 401), T11-131 (SEQ ID NO: 402), T11-134 (SEQ ID NO: 403), E147V (SEQ ID NO: 552), G164D (SEQ ID NO: 404), G304V (SEQ ID NO: 405), N258S (SEQ ID NO: 406), T71S (SEQ ID NO: 407), V184I (SEQ ID NO: 408), A279D (SEQ ID NO: 409), D98V (SEQ ID NO: 410), M169F (SEQ ID NO: 411), M169K (SEQ ID NO: 412), M169L (SEQ ID NO: 413), E100Q_M312K (SEQ ID NO: 414), ECB11 (SEQ ID NO: 534), EC2A2 (SEQ ID NO: 535), EC2B12 (SEQ ID NO: 536), EGC10 (SEQ ID NO: 537), EGD9 (SEQ ID NO: 538), EGG8 (SEQ ID NO: 539), EHG1 (SEQ ID NO: 540), EHG2 (SEQ ID NO: 541), EHH6 (SEQ ID NO: 520), EHH9 (SEQ ID NO: 521), EHH10 (SEQ ID NO: 522), EHH12 (SEQ ID NO: 523), EKC5 (SEQ ID NO: 546), EKG4 (SEQ ID NO: 547), EJF5 (SEQ ID NO: 548), EJB8 (SEQ ID NO: 549), EJA1

(SEQ ID NO: 550), EJB10 (SEQ ID NO: 551), K9_Lucy_SH (SEQ ID NO: 553), or K9JM1 (SEQ ID NO: 192), or an active fragment thereof; or b) a heterologous polynucleotide encoding the polypeptide of a); wherein the heterologous polypeptide with ketol-acid reductoisomerase activity has a $K_M$ for NADH less than about 50.

In embodiments, the host cell is a yeast host cell. In embodiments, the yeast is selected from the group consisting of yeast cell is a member of a genus of *Saccharomyces, Schizosaccharomyces, Hansenula, Candida, Kluyveromyces, Yarrowia, Issatchenkia,* or *Pichia*. In embodiments, the host cell is *Saccharomyces cerevisiae*.

In embodiments, the host cell comprises an isobutanol production pathway. In embodiments, the isobutanol production pathway comprises the following substrate to product conversions: pyruvate to acetolactate; acetolactate to 2,3-dihydroxyisovalerate; 2,3-dihydroxyisovalerate to 2-ketoisovalerate; 2-ketoisovalerate to isobutyraldehyde; and; isobutyraldehyde to isobutanol; wherein more than one, more than two, more than three, more than four, or all of the substrate to product conversions are catalyzed by an enzyme that is heterologous to the host cell. In embodiments, the substrate to product conversion for isobutyraldehyde to isobutanol is catalyzed by an alcohol dehydrogenase enzyme which utilizes NADH as a cofactor. In embodiments, host cell has reduced or eliminated acetolactate reductase activity. In embodiments, the host cell has reduced or eliminated aldehyde dehydrogenase activity. In embodiments, the host cell is yeast and has reduced or eliminated pyruvate decarboxylase activity. In embodiments, the substrate to product conversions are catalyzed by enzymes substantially localized to the cytosol.

In embodiments, the polypeptides provided herein have an E value of $<10^{-3}$ when compared to the KARI profile HMM given in Table Z.

Provided herein are methods for producing isobutanol comprising: a) providing a recombinant host cell provided herein; and b) contacting the host cell of a) with a carbon substrate under conditions whereby isobutanol is produced. In embodiments, at least a portion of the contacting occurs under anaerobic conditions. In embodiments, the molar ratio of isobutanol to glycerol is greater than 1.

Also provided are methods for producing isobutanol comprising: a) providing a recombinant host cell which produces isobutanol; and b) contacting the host cell of a) with a carbon substrate under conditions whereby isobutanol is produced; wherein at least a portion of the contacting occurs under anaerobic conditions; and wherein the ratio of isobutanol to glycerol produced is greater than 1.

Provided are compositions comprising isobutanol and a recombinant host cell disclosed herein.

Provided herein are polypeptides comprising at least about 90% identity or at least about 95% identity or at least about 99% identity to K9JM2 (SEQ ID NO: 193), K9JM3 (SEQ ID NO: 194), K9JM4 (SEQ ID NO: 195), K9JM5 (SEQ ID NO: 196), K9JM6 (SEQ ID NO: 197), K9JM7 (SEQ ID NO: 198), K9JM8 (SEQ ID NO: 199), K9JM9 (SEQ ID NO: 200), K9JM10 (SEQ ID NO: 201), K9JM11 (SEQ ID NO: 202), K9JM12 (SEQ ID NO: 203), K9JM13 (SEQ ID NO: 204), K9JM14 (SEQ ID NO: 205), K9JM15 (SEQ ID NO: 206), K9JM16 (SEQ ID NO: 207), K9JM17 (SEQ ID NO: 208), K9JM18 (SEQ ID NO: 209), K9JM19 (SEQ ID NO: 210), K9JM20 (SEQ ID NO: 211), K9JM21 (SEQ ID NO: 212), K9JM22 (SEQ ID NO: 213), K9JM23 (SEQ ID NO: 214), K9JM24 (SEQ ID NO: 215), K9JM25 (SEQ ID NO: 216), K9JM26 (SEQ ID NO: 217), K9JM27 (SEQ ID NO: 218), K9JM28 (SEQ ID NO: 219), K9JM29 (SEQ ID NO: 220), K9JM30 (SEQ ID NO: 221), K9JM31 (SEQ ID NO: 222), JM32 (SEQ ID NO: 223), JM33 (SEQ ID NO: 224), JM34 (SEQ ID NO: 225), JM35 (SEQ ID NO: 226), JM36 (SEQ ID NO: 227), JM37 (SEQ ID NO: 228), JM38 (SEQ ID NO: 229), JM39 (SEQ ID NO: 230), JM40 (SEQ ID NO: 231), JM42 (SEQ ID NO: 232), JM43 (SEQ ID NO: 233), JM44 (SEQ ID NO: 234), K9_DAVID_SH (SEQ ID NO: 236), K9ALL3 (SEQ ID NO: 237), K9_URSALA (K9SB2+A56V) (SEQ ID NO: 239), JM41 (SEQ ID NO: 240), K9ALL148 (SEQ ID NO: 241), K9JM148 (SEQ ID NO: 242), K9ALL156 (SEQ ID NO: 243), K9JM156 (SEQ ID NO: 244), K9ALL191 (SEQ ID NO: 245), K9JM191 (SEQ ID NO: 246), K9ALL254 (SEQ ID NO: 247), K9ALL278 (SEQ ID NO: 248), K9ALL37 (SEQ ID NO: 249), K9JM37S (SEQ ID NO: 250), K9ALL66 (SEQ ID NO: 66), K9JM66 (SEQ ID NO: 252), K9ALL8Q (SEQ ID NO: 253), K9JM8Q (SEQ ID NO: 254), K9ALL45 (SEQ ID NO: 255), K9_LUCY (SEQ ID NO: 300), K9_ILYA (SEQ ID NO: 301), K9ALL258 (SEQ ID NO: 302), K9YW25-T191S (SEQ ID NO: 303), F53L (SEQ ID NO: 307), F53I (SEQ ID NO: 308), F53M (SEQ ID NO: 309), F53V (SEQ ID NO: 310), F53P (SEQ ID NO: 311), F53S (SEQ ID NO: 312), F53A (SEQ ID NO: 313), F53E (SEQ ID NO: 314), F53Q (SEQ ID NO: 315), T11-1 (SEQ ID NO: 316), T11-2 (SEQ ID NO: 317), T11-3 (SEQ ID NO: 318), T11-4 (SEQ ID NO: 319), T11-5 (SEQ ID NO: 320), T11-6 (SEQ ID NO: 321), T11-7 (SEQ ID NO: 322), T11-10 (SEQ ID NO: 323), T11-12 (SEQ ID NO: 324), T11-13 (SEQ ID NO: 325), T11-14 (SEQ ID NO: 326), T11-15 (SEQ ID NO: 327), T11-16 (SEQ ID NO: 328), T11-18 (SEQ ID NO: 329), T11-19 (SEQ ID NO: 330), T11-21 (SEQ ID NO: 331), T11-22 (SEQ ID NO: 332), T11-25 (SEQ ID NO: 333), T11-27 (SEQ ID NO: 334), T11-28 (SEQ ID NO: 335), T11-29 (SEQ ID NO: 336), T11-30 (SEQ ID NO: 337), T11-32 (SEQ ID NO: 338), T11-33 (SEQ ID NO: 339), T11-35 (SEQ ID NO: 340), T11-36 (SEQ ID NO: 341), T11-37 (SEQ ID NO: 342), T11-38 (SEQ ID NO: 343), T11-39 (SEQ ID NO: 344), T11-42 (SEQ ID NO: 345), T11-43 (SEQ ID NO: 346), T11-44 (SEQ ID NO: 347), T11-45 (SEQ ID NO: 348), T11-46 (SEQ ID NO: 349), T11-47 (SEQ ID NO: 350), T11-49 (SEQ ID NO: 351), T11-50 (SEQ ID NO: 352), T11-52 (SEQ ID NO: 353), T11-54 (SEQ ID NO: 354), T11-55 (SEQ ID NO: 355), T11-56 (SEQ ID NO: 356), T11-57 (SEQ ID NO: 357), T11-58 (SEQ ID NO: 358), T11-59 (SEQ ID NO: 359), T11-60 (SEQ ID NO: 360), T11-61 (SEQ ID NO: 361), T11-62 (SEQ ID NO: 362), T11-64 (SEQ ID NO: 363), T11-66 (SEQ ID NO: 364), T11-67 (SEQ ID NO: 365), T11-69 (SEQ ID NO: 366), T11-70 (SEQ ID NO: 367), T11-72 (SEQ ID NO: 368), T11-74 (SEQ ID NO: 369), T11-75 (SEQ ID NO: 370), T11-76 (SEQ ID NO: 371), T11-79 (SEQ ID NO: 372), T11-80 (SEQ ID NO: 373), T11-81 (SEQ ID NO: 374), T11-83 (SEQ ID NO: 375), T11-84 (SEQ ID NO: 376), T11-85 (SEQ ID NO: 377), T11-86 (SEQ ID NO: 378), T11-87 (SEQ ID NO: 379), T11-88 (SEQ ID NO: 380), T11-91 (SEQ ID NO: 381), T11-94 (SEQ ID NO: 382), T11-95 (SEQ ID NO: 383), T11-96 (SEQ ID NO: 384), T11-97 (SEQ ID NO: 385), T11-99 (SEQ ID NO: 386), T11-103 (SEQ ID NO: 387), T11-104 (SEQ ID NO: 388), T11-109 (SEQ ID NO: 389), T11-110 (SEQ ID NO: 390), T11-111 (SEQ ID NO: 391), T11-114 (SEQ ID NO: 392), T11-116 (SEQ ID NO: 393), T11-117 (SEQ ID NO: 394), T11-119 (SEQ ID NO: 395), T11-121 (SEQ ID NO: 396), T11-122 (SEQ ID NO: 397), T11-124 (SEQ ID NO: 398), T11-125 (SEQ ID NO: 399), T11-128 (SEQ ID NO: 400), T11-130 (SEQ ID NO: 401), T11-131 (SEQ ID NO: 402), T11-134 (SEQ ID NO: 403), E147V (SEQ ID NO: 552), G164D (SEQ ID NO: 404), G304V (SEQ ID NO: 405), N258S (SEQ ID NO: 406), T71S (SEQ ID NO: 407), V184I (SEQ ID NO: 408), A279D (SEQ ID NO: 409), D98V (SEQ ID NO: 410), M169F (SEQ ID NO: 411), M169K (SEQ ID NO: 412), M169L (SEQ ID NO: 413), E100Q_M312K (SEQ ID NO: 414), ECB11 (SEQ ID NO: 534), EC2A2 (SEQ ID NO: 535), EC2B12 (SEQ ID NO: 536), EGC10 (SEQ ID NO: 537), EGD9 (SEQ ID NO: 538), EGG8 (SEQ ID NO: 539), EHG1 (SEQ ID NO: 540), EHG2 (SEQ ID NO: 541), EHH6 (SEQ ID NO: 520), EHH9 (SEQ ID NO: 521), EHH10 (SEQ ID NO: 522), EHH12 (SEQ ID NO: 523), EKC5 (SEQ ID NO: 546), EKG4 (SEQ ID NO: 547), EJF5 (SEQ ID NO: 548), EJB8 (SEQ ID NO: 549), EJA1 (SEQ ID NO: 550), EJB10 (SEQ ID NO: 551), K9_Lucy_SH (SEQ ID NO: 553), or K9JM1 (SEQ ID NO: 192), or an active fragment thereof wherein said polypeptide has ketol-acid reductoisomerase activity. Also provided are polynucleotides encoding such polypeptides. Accordingly, provided are recombinant host cells comprising such polypeptides and recombinant host cells comprising such polynucleotides. In embodiments, recombinant host cells further comprise an isobutanol biosynthetic pathway. In embodiments, such recombinant host cells are employed in methods of producing isobutanol.

Provided are methods of converting acetolactate to 2,3-dihydroxyisovalerate comprising: a) providing a polypeptide disclosed herein; and b) contacting the polypeptide of a) with acetolactate under conditions wherein 2,3-dihydroxyisovalerate is produced.

Also provided herein are methods for converting acetolactate to dihydroxyisovalerate comprising the polypeptides provided. Also provided are methods for converting acetolactate to dihydroxyisovalerate comprising providing a microbial host cell comprising a polypeptide provided; and contacting the polypeptide with acetolactate wherein dihydroxyisovalerate is produced. Also provided are methods of producing a product selected from the group consisting of isobutanol, pantothenate, valine, leucine, isoleucine, 3,3-dimethylmalate, and 2-methyl-1-butanol comprising: providing a recombinant host cell provided herein wherein the recombinant host cell comprises a product biosynthetic pathway; and contacting the microbial host cell with a carbon substrate under conditions whereby the product is produced. In embodiments, at least a portion of the contacting occurs under anaerobic conditions.

BRIEF DESCRIPTION OF THE FIGURES AND SEQUENCE DESCRIPTIONS

The invention can be more fully understood from the following detailed description, the Figures, and the accompanying sequence descriptions, which form part of this application.

Figure 1:
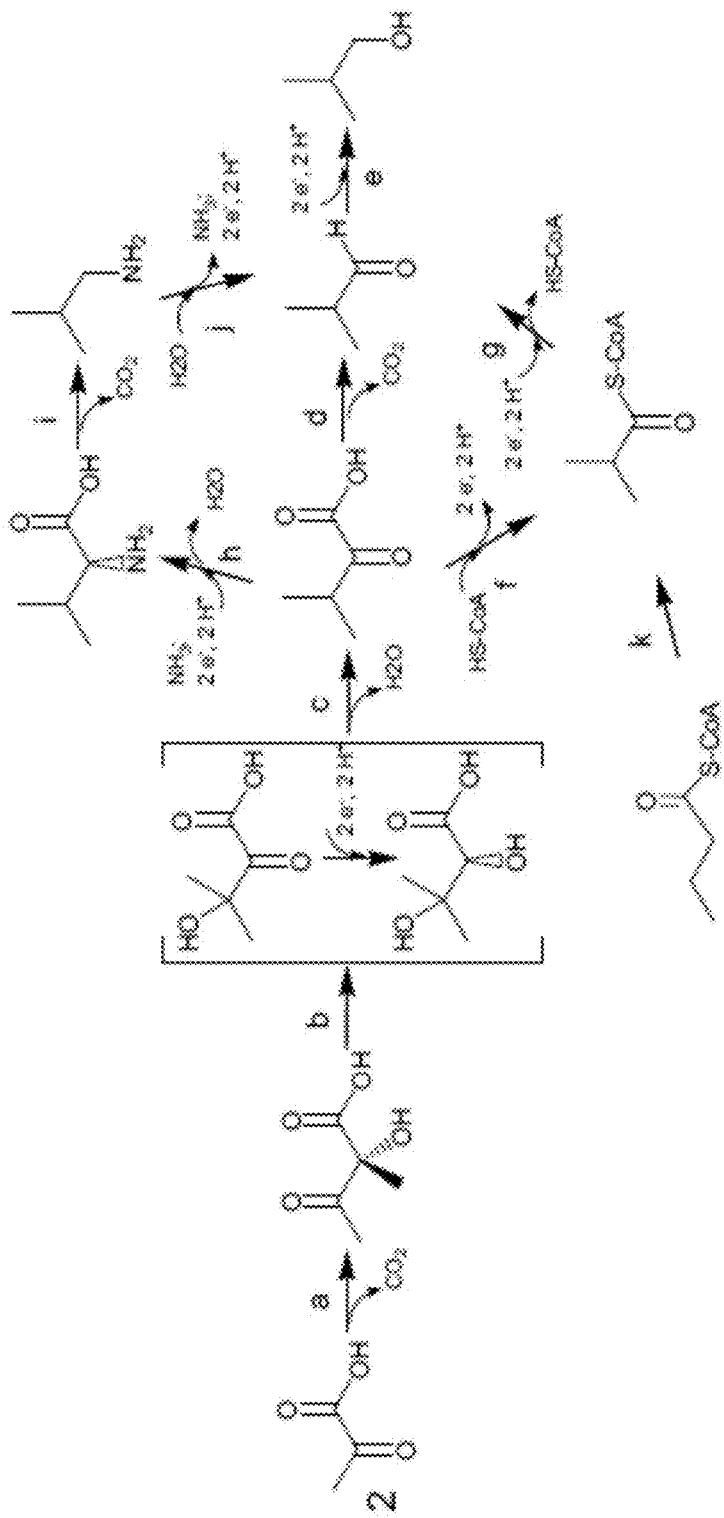
FIG. 1 shows four different isobutanol biosynthetic pathways. The steps labeled "a", "b", "c", "d", "e", "f", "g", "h", "i", "j" and "k" represent the substrate to product conversions described below.
Figure 2:
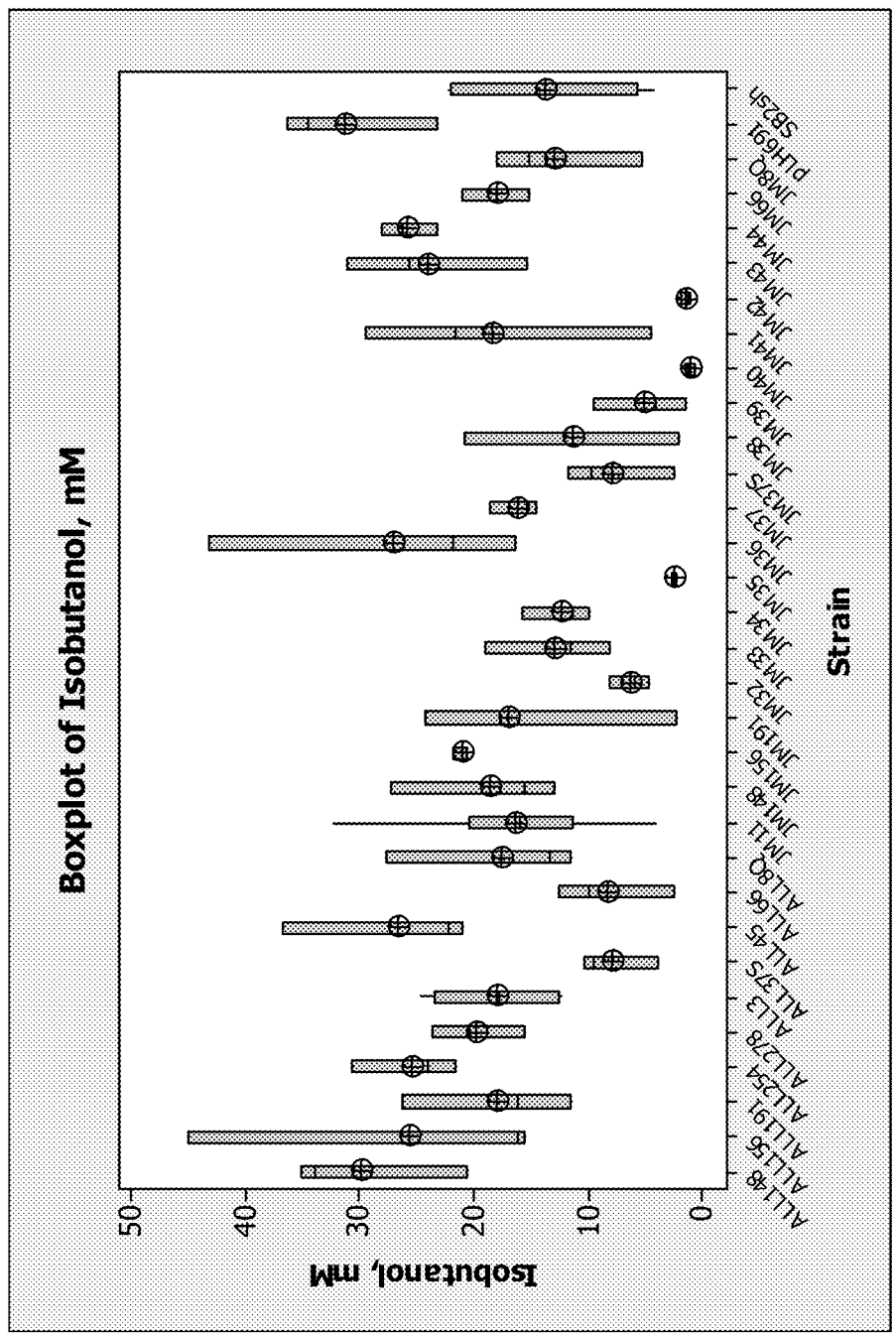
FIG. 2 depicts a box plot of isobutanol produced (mM) by indicated variants (see Example 5).

Table Z—is a table of the Profile HMM of experimentally verified KARI enzymes listed in Table A and as described in US App. Pub. Nos. 20100197519 and 20090163376.

TABLE A

Experimentally verified KARI enzymes.

| GI Number | Accession | Microorganism |
|---|---|---|
| 70732562 | YP_262325.1 | *Pseudomonas fluorescens* Pf-5 |
| 15897495 | NP_342100.1 | *Sulfolobus solfataricus* P2 |
| 18313972 | NP_560639.1 | *Pyrobaculum aerophilum* str. IM2 |
| 76801743 | YP_326751.1 | *Natronomonas pharaonis* DSM 2160 |
| 16079881 | NP_390707.1 | *Bacillus subtilis* subsp. *subtilis* str. 168 |
| 19552493 | NP_600495.1 | *Corynebacterium glutamicum* ATCC 13032 |
| 6225553 | O32414 | *Phaeospririlum molischianum* |
| 17546794 | NP_520196.1 | *Ralstonia solanacearum* GMI1000 |
| 56552037 | YP_162876.1 | *Zymomonas mobilis* subsp. *mobilis* ZM4 |
| 114319705 | YP_741388.1 | *Alkalilimnicola ehrlichei* MLHE-1 |
| 57240359 | ZP_00368308.1 | *Campylobacter lari* RM2100 |
| 120553816 | YP_958167.1 | *Marinobacter aquaeolei* VT8 |
| 71065099 | YP_263826.1 | *Psychrobacter arcticus* 273-4 |
| 83648555 | YP_436990.1 | *Hahella chejuensis* KCTC 2396 |
| 74318007 | YP_315747.1 | *Thiobacillus denitrificans* ATCC 25259 |
| 67159493 | ZP_00420011.1 | *Azotobacter vinelandii* AvOP |
| 66044103 | YP_233944.1 | *Pseudomonas syringae* pv. *syringae* B728a |
| 28868203 | NP_790822.1 | *Pseudomonas syringae* pv. tomato str. DC3000 |
| 26991362 | NP_746787.1 | *Pseudomonas putida* KT2440 |
| 104783656 | YP_610154.1 | *Pseudomonas entomophila* L48 |
| 146306044 | YP_001186509.1 | *Pseudomonas mendocina* ymp |
| 15599888 | NP_253382.1 | *Pseudomonas aeruginosa* PAO1 |
| 42780593 | NP_977840.1 | *Bacillus cereus* ATCC 10987 |
| 42781005 | NP_978252.1 | *Bacillus cereus* ATCC 10987 |
| 266346 | Q01292 | *Spinacia oleracea* |

The eleven positions in the profile HMM representing the columns in the alignment which correspond to the eleven cofactor switching positions in *Pseudomonas fluorescens* Pf-5 KARI are identified as positions 24, 33, 47, 50, 52, 53, 61, 80, 115, 156, and 170. Table Z is submitted herewith electronically and is incorporated herein by reference.

The sequences provided in the sequence listing filed electronically herewith are herein incorporated by reference. Consistent with the Standard, certain primers given in the sequence listing and in the Table of Sequences herein may use N to represent nucleotides a or g or c or t; K is used to represent g or t; M is used to represent a or c.

DETAILED DESCRIPTION OF THE INVENTION

Unless defined otherwise, all technical and scientific terms used herein have the same meaning as commonly understood by one of ordinary skill in the art to which this invention belongs. In case of conflict, the present application including the definitions will control. Also, unless otherwise required by context, singular terms shall include pluralities and plural terms shall include the singular. All publications, patents and other references mentioned herein are incorporated by reference in their entireties for all purposes.

It will be understood that "derived from" with reference to polypeptides disclosed herein encompasses sequences synthesized based on the amino acid sequences of the KARIs present in the indicated organisms as well as those cloned directly from the organism's genetic material.

"Engineered polypeptide" as used herein refers to a polypeptide that is synthetic, i.e., differing in some manner from a polypeptide found in nature.

In order to further define this invention, the following terms and definitions are herein provided.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers. For example, a composition, a mixture, a process, a method, an article, or an apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the term "consists of," or variations such as "consist of" or "consisting of," as used throughout the specification and claims, indicate the inclusion of any recited integer or group of integers, but that no additional integer or group of integers may be added to the specified method, structure, or composition.

As used herein, the term "consists essentially of," or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure or composition. See M.P.E.P. §2111.03.

Also, the indefinite articles "a" and "an" preceding an element or component of the invention are intended to be nonrestrictive regarding the number of instances, i.e., occurrences of the element or component. Therefore "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the application.

As used herein, the term "about" modifying the quantity of an ingredient or reactant of the invention employed refers to variation in the numerical quantity that can occur, for example, through typical measuring and liquid handling procedures used for making concentrates or solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, preferably within 5% of the reported numerical value.

The term "invention" or "present invention" as used herein is meant to apply generally to all embodiments of the invention as described in the claims as presented or as later amended and supplemented, or in the specification.

The term "isobutanol biosynthetic pathway" refers to the enzymatic pathway to produce isobutanol. Certain isobutanol biosynthetic pathways are illustrated in FIG. 1 and described herein. From time to time "isobutanol biosynthetic pathway" is used synonymously with "isobutanol production pathway".

A recombinant host cell comprising an "engineered alcohol production pathway" (such as an engineered butanol or isobutanol production pathway) refers to a host cell containing a modified pathway that produces alcohol in a manner different than that normally present in the host cell. Such differences include production of an alcohol not typically produced by the host cell, or increased or more efficient production.

The term "effective isobutanol productivity" as used herein refers to the total amount in grams of isobutanol produced per gram of cells.

The term "effective titer" as used herein, refers to the total amount of butanol produced by fermentation per liter of fermentation medium. The total amount of butanol includes: (i) the amount of butanol in the fermentation medium; (ii) the amount of butanol recovered from the organic extractant; and (iii) the amount of butanol recovered from the gas phase, if gas stripping is used.

The term "effective rate" as used herein, refers to the total amount of butanol produced by fermentation per liter of fermentation medium per hour of fermentation.

The term "effective yield" as used herein, refers to the amount of butanol produced per unit of fermentable carbon substrate consumed by the biocatalyst.

The term "NADPH consumption assay" refers to an enzyme assay for the determination of the specific activity of the KARI enzyme, involving measuring the disappearance of the KARI cofactor, NADPH, from the enzyme reaction.

"KARI" is the abbreviation for the enzyme ketol-acid reductoisomerase.

The term "close proximity" when referring to the position of various amino acid residues of a KARI enzyme with respect to the adenosyl 2'-phosphate of NADPH means amino acids in the three-dimensional model for the structure of the enzyme that are within about 4.5 Å of the phosphorus atom of the adenosyl 2'-phosphate of NADPH bound to the enzyme.

The term "ketol-acid reductoisomerase" (abbreviated "KARI"), and "acetohydroxy acid isomeroreductase" will be used interchangeably and refer to enzymes capable of catalyzing the reaction of (S)-acetolactate to 2,3-dihydroxy-isovalerate, classified as EC number EC 1.1.1.86 (*Enzyme Nomenclature* 1992, Academic Press, San Diego). As used herein the term "Class I ketol-acid reductoisomerase enzyme" means the short form that typically has between 330 and 340 amino acid residues, and is distinct from the long form, called class II, that typically has approximately 490 residues.

The terms "ketol-acid reductoisomerase activity" and "KARI activity" refers to the ability to catalyze the substrate to product conversion (S)-acetolactate to 2,3-dihydroxyisovalerate.

The term "acetolactate synthase" ("ALS") refers to an enzyme that catalyzes the conversion of pyruvate to acetolactate and $CO_2$. Acetolactate has two stereoisomers ((R) and (S)); the enzyme prefers the (S)-isomer, which is made by biological systems. Example acetolactate synthases are known by the EC number 2.2.1.6 (*Enzyme Nomenclature* 1992, Academic Press, San Diego). These enzymes are available from a number of sources, including, but not limited to, *Bacillus subtilis* (GenBank Nos: CAB15618, Z99122, NCBI (National Center for Biotechnology Information) amino acid sequence, NCBI nucleotide sequence, respectively), *Klebsiella pneumoniae* (GenBank Nos: AAA25079, M73842 and *Lactococcus lactis* (GenBank Nos: AAA25161, L16975).

The term "acetohydroxy acid dehydratase" or "dihydroxyacid dehydratase" ("DHAD") refers to an enzyme that catalyzes the conversion of 2,3-dihydroxyisovalerate to α-ketoiso-valerate. Example acetohydroxy acid dehydratases are known by the EC number 4.2.1.9. These enzymes are available from a vast array of microorganisms, including, but not limited to, *E. coli* (GenBank Nos: YP_026248, NC_000913, *S. cerevisiae* (GenBank Nos: NP_012550, NC_001142), *M. maripaludis* (GenBank Nos: CAF29874, BX957219), and *B. subtilis* (GenBank Nos: CAB14105, Z99115). Suitable DHAD sequences are known in the art and/or provided herein.

The term "branched-chain α-keto acid decarboxylase" (also referred to herein as "ketoisovalerate decarboxylase" or "kivD") refers to an enzyme that catalyzes the conversion of α-ketoisovalerate to isobutyraldehyde and $CO_2$. Example branched-chain α-keto acid decarboxylases are known by the EC number 4.1.1.72 and are available from a number of sources, including, but not limited to, *Lactococcus lactis* (GenBank Nos: AAS49166, AY548760; CAG34226, AJ746364, *Salmonella typhimurium* (GenBank Nos: NP-461346, NC-003197), and *Clostridium acetobutylicum* (GenBank Nos: NP-149189, NC-001988).

The term "branched-chain alcohol dehydrogenase" (also referred to herein as "alcohol dehydrogenase" or "ADH") refers to an enzyme that catalyzes the conversion of isobutyraldehyde to isobutanol. Example branched-chain alcohol dehydrogenases are known by the EC number 1.1.1.265, but may also be classified under other alcohol dehydrogenases (specifically, EC 1.1.1.1 or 1.1.1.2). These enzymes may utilize NADH (reduced nicotinamide adenine dinucleotide) and/or NADPH as electron donor and are available from a number of sources, including, but not limited to, *S. cerevisiae* (GenBank Nos: NP-010656, NC-001136; NP-014051, NC-001145), *E. coli* (GenBank Nos: NP-417484, and *C. acetobutylicum* (GenBank Nos: NP-349892, NC_003030).

The term "branched-chain keto acid dehydrogenase" refers to an enzyme that catalyzes the conversion of α-ketoisovalerate to isobutyryl-CoA (isobutyryl-cofactor A). Such enzymes may use $NAD^+$ (nicotinamide adenine dinucleotide) as electron acceptor. Example branched-chain keto acid dehydrogenases are known by the EC number 1.2.4.4. These branched-chain keto acid dehydrogenases comprise four subunits, and sequences from all subunits are available from a vast array of microorganisms, including, but not limited to, *B. subtilis* (GenBank Nos: CAB14336, Z99116; CAB14335, Z99116; CAB14334, Z99116; and CAB14337, Z99116) and *Pseudomonas putida* (GenBank Nos: AAA65614, M57613; AAA65615, M57613; AAA65617, M57613; and AAA65618, M57613).

The term "carbon substrate" or "fermentable carbon substrate" refers to a carbon source capable of being metabolized by host organisms of the present invention and particularly carbon sources selected from the group consisting of monosaccharides, oligosaccharides, polysaccharides, and one-carbon substrates or mixtures thereof.

The term "specific activity" as used herein is defined as the units of activity in a given amount of protein. Thus, the specific activity is not directly measured but is calculated by dividing 1) the activity in units/ml of the enzyme sample by 2) the concentration of protein in that sample, so the specific activity is expressed as units/mg. The specific activity of a sample of pure, fully active enzyme is a characteristic of that enzyme. The specific activity of a sample of a mixture of proteins is a measure of the relative fraction of protein in that sample that is composed of the active enzyme of interest.

The terms "$k_{cat}$" and "$K_M$" are known to those skilled in the art and are described in Enzyme Structure and Mechanism, 2nd ed. (Ferst; W.H. Freeman Press, NY, 1985; pp 98-120). $K_M$, the Michaelis constant, is the concentration of substrate that leads to half-maximal velocity. The term "$k_{cat}$", often called the "turnover number", is defined as the maximum number of substrate molecules converted to products per active site per unit time, or the number of times the enzyme turns over per unit time. $k_{cat}=V_{max}/[E]$, where [E] is the enzyme concentration (Ferst, supra). The terms "total turnover" and "total turnover number" are used herein to refer to the amount of product formed by the reaction of a KARI enzyme with substrate.

The term "catalytic efficiency" is defined as the $k_{cat}/K_M$ of an enzyme. Catalytic efficiency is used to quantify the specificity of an enzyme for a substrate.

The term "isolated nucleic acid molecule", "isolated nucleic acid fragment" and "genetic construct" will be used interchangeably and will mean a polymer of RNA or DNA that is single- or double-stranded, optionally containing synthetic, non-natural or altered nucleotide bases. An isolated nucleic acid fragment in the form of a polymer of DNA may be comprised of one or more segments of cDNA, genomic DNA or synthetic DNA.

The term "amino acid" refers to the basic chemical structural unit of a protein or polypeptide. The following abbreviations are used herein to identify specific amino acids:

| Amino Acid | Three-Letter Abbreviation | One-Letter Abbreviation |
|---|---|---|
| Alanine | Ala | A |
| Arginine | Arg | R |
| Asparagine | Asn | N |
| Aspartic acid | Asp | D |
| Cysteine | Cys | C |
| Glutamine | Gln | Q |
| Glutamic acid | Glu | E |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of a microorganism. A "foreign" gene refers to a gene not normally found in the host microorganism, but that is introduced into the host microorganism by gene transfer.

Foreign genes can comprise native genes inserted into a non-native microorganism, or chimeric genes. A "transgene" is a gene that has been introduced into the genome by a transformation procedure.

As used herein the term "coding sequence" refers to a DNA sequence that encodes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, introns, polyadenylation recognition sequences, RNA processing site, effector binding site and stem-loop structure.

The term "endogenous," when used in reference to a polynucleotide, a gene, or a polypeptide refers to a native polynucleotide or gene in its natural location in the genome of an organism, or for a native polypeptide, is transcribed and translated from this location in the genome.

The term "heterologous" when used in reference to a polynucleotide, a gene, or a polypeptide refers to a polynucleotide, gene, or polypeptide not normally found in the host organism. "Heterologous" also includes a native coding region, or portion thereof, that is reintroduced into the source organism in a form that is different from the corresponding native gene, e.g., not in its natural location in the organism's genome. The heterologous polynucleotide or gene may be introduced into the host organism by, e.g., gene transfer. A heterologous gene may include a native coding region with non-native regulatory regions that is reintroduced into the native host. A "transgene" is a gene that has been introduced into the genome by a transformation procedure.

The term "recombinant genetic expression element" refers to a nucleic acid fragment that expresses one or more specific proteins, including regulatory sequences preceding (5' non-coding sequences) and following (3' termination sequences) coding sequences for the proteins. A chimeric gene is a recombinant genetic expression element. The coding regions of an operon may form a recombinant genetic expression element, along with an operably linked promoter and termination region.

"Regulatory sequences" refers to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, enhancers, operators, repressors, transcription termination signals, translation leader sequences, introns, polyadenylation recognition sequences, RNA processing site, effector binding site and stem-loop structure.

The term "promoter" refers to a nucleic acid sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic nucleic acid segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters". "Inducible promoters," on the other hand, cause a gene to be expressed when the promoter is induced or turned on by a promoter-specific signal or molecule. It is further recognized that since in most cases the exact boundaries of regulatory sequences have not been completely defined, DNA fragments of different lengths may have identical promoter activity. For example, it will be understood that "FBA1 promoter" can be used to refer to a fragment derived from the promoter region of the FBA1 gene.

The term "terminator" as used herein refers to DNA sequences located downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence. It is recognized that since in most cases the exact boundaries of regulatory sequences have not been completely defined, DNA fragments of different lengths may have identical terminator activity. For example, it will be understood that "CYC1 terminator" can be used to refer to a fragment derived from the terminator region of the CYC1 gene.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression", as used herein, refers to the transcription and stable accumulation of sense (mRNA) or antisense RNA derived from the nucleic acid fragment of the invention. Expression may also refer to translation of mRNA into a polypeptide.

As used herein the term "transformation" refers to the transfer of a nucleic acid fragment into the genome of a host microorganism, resulting in genetically stable inheritance. Host microorganisms containing the transformed nucleic acid fragments are referred to as "transgenic" or "recombinant" or "transformed" microorganisms.

The terms "plasmid", "vector" and "cassette" refer to an extra chromosomal element often carrying genes which are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host.

The term "site-saturation library" refers to a library which contains random substitutions at a specific amino acid position with all 20 possible amino acids at once.

The term "error-prone PCR" refers to adding random copying errors by imposing imperfect or 'sloppy' PCR reaction conditions which generate randomized libraries of mutations in a specific nucleotide sequence.

As used herein the term "codon degeneracy" refers to the nature in the genetic code permitting variation of the nucleotide sequence without affecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA. Such optimization includes replacing at least one, or more than one, or a significant number, of codons with one or more codons that are more frequently used in the genes of that organism.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 1A. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 1A

The Standard Genetic Code

| T | | C | | A | | G | |
|---|---|---|---|---|---|---|---|
| TTTT Phe | (F) | TCT Ser | (S) | TAT Tyr | (Y) | TGT Cys | (C) |
| TTC Phe | (F) | TTC Ser | (S) | TAC Tyr | (Y) | TGC | |
| TTA Leu | (L) | TCA Ser | (S) | TAA Stop | | TGA Stop | |
| TTG Leu | (L) | TCG Ser | (S) | TAG Stop | | TGG Trp | (W) |
| C CTT Leu | (L) | CCT Pro | (P) | CAT His | (H) | CGT Arg | (R) |
| CTC Leu | (L) | CCC Pro | (P) | CAC His | (H) | CGC Arg | (R) |
| CTA Leu | (L) | CCA Pro | (P) | CAA Gln | (Q) | CGA Arg | (R) |
| CTG Leu | (L) | CCG Pro | (P) | CAG Gln | (Q) | CGG Arg | (R) |
| AATT Ile | (I) | ACT Thr | (T) | AAT Asn | (N) | AGT Ser | (S) |
| ATC Ile | (I) | ACC Thr | (T) | AAC Asn | (N) | AGC Ser | (S) |
| ATA Ile | (I) | ACA Thr | (T) | AAA Lys | (K) | AGA Arg | (R) |
| ATG Met | (M) | ACG Thr | (T) | AAG Asn | (K) | AGG Ser | (R) |
| GGTT Val | (V) | GCT Ala | (A) | GAT Asp | (D) | GGT Gly | (G) |
| GTC Val | (V) | GCC Ala | (A) | GAC Asp | (D) | GGC Gly | (G) |
| GTA Val | (V) | GCA Ala | (A) | GAA Glu | (E) | GGA Gly | (G) |
| GTG Val | (V) | GCG Ala | (A) | GAG Glu | (E) | GGG Gly | (G) |

Many organisms display a bias for use of particular codons to code for insertion of a particular amino acid in a growing peptide chain. Codon preference, or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules.

The predominance of selected tRNAs in a cell is generally a reflection of the codons used most frequently in peptide synthesis. Accordingly, genes can be tailored for optimal gene expression in a given organism based on codon optimization.

Given the large number of gene sequences available for a wide variety of animal, plant and microbial species, it is possible to calculate the relative frequencies of codon usage. Codon usage tables are readily available, for example, at the "Codon Usage Database" available at the Kazusa DNA Research Institute, Japan, and these tables can be adapted in a number of ways. See Nakamura, Y., et al. *Nucl. Acids Res.* 28:292 (2000). Codon usage tables for yeast, calculated from GenBank Release 128.0 [15 Feb. 2002], are reproduced below as Table 1B. This table uses mRNA nomenclature, and so instead of thymine (T) which is found in DNA, the tables use uracil (U) which is found in RNA. Table 1B has been adapted so that frequencies are calculated for each amino acid, rather than for all 64 codons.

TABLE 1B

Codon Usage Table for *Saccharomyces cerevisiae*

| Amino Acid | Codon | Number | Frequency per thousand |
|---|---|---|---|
| Phe | UUU | 170666 | 26.1 |
| Phe | UUC | 120510 | 18.4 |
| Leu | UUA | 170884 | 26.2 |
| Leu | UUG | 177573 | 27.2 |
| Leu | CUU | 80076 | 12.3 |
| Leu | CUC | 35545 | 5.4 |
| Leu | CUA | 87619 | 13.4 |
| Leu | CUG | 68494 | 10.5 |
| Ile | AUU | 196893 | 30.1 |
| Ile | AUC | 112176 | 17.2 |
| Ile | AUA | 116254 | 17.8 |
| Met | AUG | 136805 | 20.9 |
| Val | GUU | 144243 | 22.1 |
| Val | GUC | 76947 | 11.8 |
| Val | GUA | 76927 | 11.8 |
| Val | GUG | 70337 | 10.8 |
| Ser | UCU | 153557 | 23.5 |
| Ser | UCC | 92923 | 14.2 |
| Ser | UCA | 122028 | 18.7 |
| Ser | UCG | 55951 | 8.6 |
| Ser | AGU | 92466 | 14.2 |

TABLE 1B-continued

Codon Usage Table for *Saccharomyces cerevisiae*

| Amino Acid | Codon | Number | Frequency per thousand |
|---|---|---|---|
| Ser | AGC | 63726 | 9.8 |
| Pro | CCU | 88263 | 13.5 |
| Pro | CCC | 44309 | 6.8 |
| Pro | CCA | 119641 | 18.3 |
| Pro | CCG | 34597 | 5.3 |
| Thr | ACU | 132522 | 20.3 |
| Thr | ACC | 832072 | 12.7 |
| Thr | ACA | 116084 | 17.8 |
| Thr | ACG | 52045 | 8.0 |
| Ala | GCU | 138358 | 21.2 |
| Ala | GCC | 82357 | 12.6 |
| Ala | GCA | 105910 | 16.2 |
| Ala | GCG | 40358 | 6.2 |
| Tyr | UAU | 122728 | 18.8 |
| Tyr | UAC | 96596 | 14.8 |
| His | CAU | 89007 | 13.6 |
| His | CAC | 50785 | 7.8 |
| Gln | CAA | 178251 | 27.3 |
| Gln | CAG | 79121 | 12.1 |
| Asn | AAU | 233124 | 35.7 |
| Asn | AAC | 162199 | 24.8 |
| Lys | AAA | 273618 | 41.9 |
| Lys | AAG | 201361 | 30.8 |
| Asp | GAU | 245641 | 37.6 |
| Asp | GAC | 132048 | 20.2 |
| Glu | GAA | 297944 | 45.6 |
| Glu | GAG | 125717 | 19.2 |
| Cys | UGU | 52903 | 8.1 |
| Cys | UGC | 31095 | 4.8 |
| Trp | UGG | 67789 | 10.4 |
| Arg | CGU | 41791 | 6.4 |
| Arg | CGC | 16993 | 2.6 |
| Arg | CGA | 19562 | 3.0 |
| Arg | CGG | 11351 | 1.7 |
| Arg | AGA | 139081 | 21.3 |
| Arg | AGG | 60289 | 9.2 |
| Gly | GGU | 156109 | 23.9 |
| Gly | GGC | 63903 | 9.8 |
| Gly | GGA | 71216 | 10.9 |
| Gly | GGG | 39359 | 6.0 |
| Stop | UAA | 6913 | 1.1 |
| Stop | UAG | 3312 | 0.5 |
| Stop | UGA | 4447 | 0.7 |

By utilizing this or similar tables, one of ordinary skill in the art can apply the frequencies to any given polypeptide sequence, and produce a nucleic acid fragment of a codon-optimized coding region which encodes the polypeptide, but which uses codons optimal for a given species.

Randomly assigning codons at an optimized frequency to encode a given polypeptide sequence, can be done manually by calculating codon frequencies for each amino acid, and then assigning the codons to the polypeptide sequence randomly. Additionally, various algorithms and computer software programs are readily available to those of ordinary skill in the art. For example, the "EditSeq" function in the Lasergene Package, available from DNAstar, Inc., Madison, Wis., the backtranslation function in the VectorNT1 Suite, available from InforMax, Inc., Bethesda, Md., and the "backtranslate" function in the GCG-Wisconsin Package, available from Accelrys, Inc., San Diego, Calif. In addition, various resources are publicly available to codon-optimize coding region sequences, e.g., the "backtranslation" function Entelechon GmbH, Regensburg, Germany) and the "backtranseq" function (NRC Saskatoon Bioinformatics, Saskatoon, Saskatchewan, Canada). Constructing a rudimentary algorithm to assign codons based on a given frequency can also easily be accomplished with basic mathematical functions by one of ordinary skill in the art.

Codon-optimized coding regions can be designed by various methods known to those skilled in the art including software packages such as "synthetic gene designer" (University of Maryland, Baltimore, Md.).

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino acids, are included within the definition of "polypeptide," and the term "polypeptide" may be used instead of, or interchangeably with any of these terms. A polypeptide may be derived from a natural biological source or produced by recombinant technology, but is not necessarily translated from a designated nucleic acid sequence. It may be generated in any manner, including by chemical synthesis.

By an "isolated" polypeptide or a fragment, variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for purposed of the invention, as are native or recombinant polypeptides which have been separated, fractionated, or partially or substantially purified by any suitable technique.

As used herein, the terms "variant" and "mutant" are synonymous and refer to a polypeptide differing from a specifically recited polypeptide by one or more amino acid insertions, deletions, mutations, and substitutions, created using, e.g., recombinant DNA techniques, such as mutagenesis. Guidance in determining which amino acid residues may be replaced, added, or deleted without abolishing activities of interest, may be found by comparing the sequence of the particular polypeptide with that of homologous polypeptides, e.g., yeast or bacterial, and minimizing the number of amino acid sequence changes made in regions of high homology (conserved regions) or by replacing amino acids with consensus sequences.

"Engineered polypeptide" as used herein refers to a polypeptide that is synthetic, i.e., differing in some manner from a polypeptide found in nature.

Alternatively, recombinant polynucleotide variants encoding these same or similar polypeptides may be synthesized or selected by making use of the "redundancy" in the genetic code. Various codon substitutions, such as silent changes which produce various restriction sites, may be introduced to optimize cloning into a plasmid or viral vector for expression. Mutations in the polynucleotide sequence may be reflected in the polypeptide or domains of other peptides added to the polypeptide to modify the properties of any part of the polypeptide. For example, mutations can be used to reduce or eliminate expression of a target protein and include, but are not limited to, deletion of the entire gene or a portion of the gene, inserting a DNA fragment into the gene (in either the promoter or coding region) so that the protein is not expressed or expressed at lower levels, introducing a mutation into the coding region which adds a stop codon or frame shift such that a functional protein is not expressed, and introducing one or more mutations into the coding region to alter amino acids so that a non-functional or a less enzymatically active protein is expressed.

Amino acid "substitutions" may be the result of replacing one amino acid with another amino acid having similar structural and/or chemical properties, i.e., conservative amino acid replacements, or they may be the result of replacing one amino acid with an amino acid having different structural and/or chemical properties, i.e., non-conservative amino acid replacements. "Conservative" amino acid substitutions may be made on the basis of similarity in polarity, charge, solubility, hydrophobicity, hydrophilicity, or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. Alternatively, "non-conservative" amino acid substitutions may be made by selecting the differences in polarity, charge, solubility, hydrophobicity, hydrophilicity, or the amphipathic nature of any of these amino acids. "Insertions" or "deletions" may be within the range of variation as structurally or functionally tolerated by the recombinant proteins. The variation allowed may be experimentally determined by systematically making insertions, deletions, or substitutions of amino acids in a polypeptide molecule using recombinant DNA techniques and assaying the resulting recombinant variants for activity.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul, S. F., et al., *J. Mol. Biol.*, 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, may now use all or a substantial portion of the disclosed sequences for purposes known to those skilled in this art. Accordingly, the instant invention comprises the complete sequences as reported in the accompanying Sequence Listing, as well as substantial portions of those sequences as defined above.

The term "complementary" is used to describe the relationship between nucleotide bases that are capable of hybridizing to one another. For example, with respect to DNA, adenine is complementary to thymine and cytosine is complementary to guanine, and with respect to RNA, adenine is complementary to uracil and cytosine is complementary to guanine.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) *Computational Molecular Biology* (Lesk, A. M., Ed.) Oxford University: NY (1988); 2.) *Biocomputing: Informatics and Genome Projects* (Smith, D. W., Ed.) Academic: NY (1993); 3.) *Computer Analysis of Sequence Data, Part I* (Griffin, A. M., and Griffin, H. G., Eds.) Humania: NJ (1994); 4.) *Sequence Analysis in Molecular Biology* (von Heinje, G., Ed.) Academic (1987); and 5.) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.). Multiple alignments of the sequences is performed using the "Clustal method of alignment" which encompasses several varieties of the algorithm including the "Clustal V method of alignment" corresponding to the alignment method labeled Clustal V (described by Higgins and Sharp, *CABIOS*. 5:151-153 (1989); Higgins, D. G. et al., *Comput. Appl. Biosci.,* 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, *CABIOS*. 5:151-153 (1989); Higgins, D. G. et al., *Comput. Appl. Biosci.* 8:189-191(1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, such as from other species, wherein such polypeptides have the same or similar function or activity, or in describing the corresponding polynucleotides. Useful examples of percent identities include, but are not limited to: 55%, 60%, 65%, 70%, 75%, 80%, 85%, 90%, or 95%, or any integer percentage from 55% to 100% may be useful in describing the present invention, such as 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable polynucleotide fragments not only have the above homologies but typically comprise a polynucleotide having at least 50 nucleotides, at least 100 nucleotides, at least 150 nucleotides, at least 200 nucleotides, or at least 250 nucleotides. Further, suitable polynucleotide fragments having the above homologies encode a polypeptide having at least 50 amino acids, at least 100 amino acids, at least 150 amino acids, at least 200 amino acids, or at least 250 amino acids.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.,* 215:403-410 (1990)); 3.) DNASTAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, *Comput. Methods Genome Res.,* [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques are well known in the art and are described by Sambrook, J., Fritsch, E. F. and Maniatis, T., *Molecular Cloning: A Laboratory Manual,* Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions,* Cold Spring Harbor Laboratory Press, Cold Spring Harbor, N.Y. (1984); and by Ausubel, F. M. et al., *Current Protocols in Molecular Biology,* published by Greene Publishing Assoc. and Wiley-Interscience (1987). Additional methods are in *Methods in Enzymology,* Volume 194, *Guide to Yeast Genetics and Molecular and Cell Biology* (Part A, 2004, Christine Guthrie and Gerald R. Fink (Eds.), Elsevier Academic Press, San Diego, Calif.). Other molecular tools and techniques are known in the art and include splicing by overlapping extension polymerase chain reaction (PCR) (Yu, et al. (2004) Fungal Genet. Biol. 41:973-981), positive selection for mutations at the URA3 locus of *Saccharomyces cerevisiae* (Boeke, J. D. et al. (1984) Mol. Gen. Genet. 197, 345-346; M A Romanos, et al. Nucleic Acids Res. 1991 Jan. 11; 19(1): 187), the cre-lox site-specific recombination system as well as mutant lox sites and FLP substrate mutations (Sauer, B. (1987) Mol Cell Biol 7: 2087-2096; Senecoff, et al. (1988) Journal of Molecular Biology, Volume 201, Issue 2, Pages 405-421; Albert, et al. (1995) The Plant Journal. Volume 7, Issue 4, pages 649-659), "seamless" gene deletion (Akada, et al. (2006) Yeast; 23(5):399-405), and gap repair methodology (Ma et al., *Genetics* 58:201-216; 1981).

The recombinant host cells and methods provided herein address a need that arises in the microbial production of isobutanol where the KARI enzyme performs a vital role. In the isobutanol biosynthetic pathway shown in FIG. 1, the substrate to product conversion of acetolactate to dihydroxyisovalerate (DHIV) is catalyzed by the KARI enzyme.

Production of isobutanol typically utilizes the glycolysis pathway present in the host microorganism. During the production of two molecules of pyruvate from glucose during glycolysis, there is net production of two molecules of NADH from NAD+ by the glyceraldehyde-3-phosphate dehydrogenase reaction. During the further production of one molecule of isobutanol from two molecules of pyruvate, there is net consumption of one molecule of NAD(P)H, by the KARI reaction, and one molecule of NAD(P)H by the isobutanol dehydrogenase reaction. The interconversion of NADH with NADPH is generally slow and inefficient in yeast; thus, NADPH to be consumed is generated by metabolism (for example, by the pentose phosphate pathway) consuming substrate in the process. Meanwhile, the cell strives to maintain homeostasis in the NAD+/NADH ratio, leading to the excess NADH produced in isobutanol production being consumed in wasteful reduction of other metabolic intermediates; e.g., by the production of lactate from pyruvate. Thus, an imbalance between NADH produced and NADPH consumed by the isobutanol pathway can lead to a reduction in the molar yield of isobutanol produced from glucose in two ways: 1) unnecessary operation of metabolism to produce NADPH, and 2) wasteful reaction of metabolic intermediates to maintain NAD+/NADH homeostasis.

Polypeptides with KARI Activity Suited for Biosynthetic Pathways

Disclosed herein are variants of a KARI enzyme from *Anaerostipes caccae*. Such variants provide alternatives for optimizing the efficiency of a biosynthetic pathway utilizing KARI, such as an isobutanol biosynthetic pathway, for particular production conditions. Demonstrated in the Examples is isobutanol production employing variants of the K9 KARI enzyme derived from *Anaerostipes caccae*. Thus, equipped with this disclosure, one of skill in the art will be able to produce recombinant host cells comprising a disclosed KARI enzyme or a variant or active fragment thereof suited for a range of production conditions. As such, the variants provided herein may also be useful in other biosynthetic pathways comprising a substrate to product conversion catalyzed by KARI activity.

In embodiments, polypeptides provided herein with KARI activity comprise substitutions in amino acids corresponding to S56 and S58 of SEQ ID NO: 93. In embodiments, polypeptides provided herein with KARI activity comprise substitutions in amino acids corresponding to Y53 of SEQ ID NO: 93. In some embodiments the amino acid at the position corresponding to S56 is A. In some embodiments, the amino acid at the position corresponding to S58 is D or E. In some embodiments, the amino acid at the position corresponding to Y53 is F, I, L, V, P, M, S, Q, E, P, or A. In some embodiments, the amino acid at the position corresponding to S56 is V or D. In some embodiments, the amino acid at the position corresponding to S58 is D or Q.

In embodiments, polypeptides provided herein comprise substitutions at the amino acids corresponding to those at positions 90 or 93 or both of SEQ ID NO: 93. In embodiments, the amino acid at position 90 is M, L, Y, or A. In embodiments, the amino acid at position 93 is I, A, V, L, or T. In embodiments, both positions are substituted. Example combinations of the substitutions are shown in Table 3. In embodiments, such polypeptides have KARI activity.

In other embodiments, polypeptides provided herein comprise substitutions at the amino acids corresponding to those at positions 90 or 93 or 94 or a combination thereof of SEQ ID NO: 93. In embodiments, the amino acid at position 90 is K, M, or Y. In embodiments, the amino acid at position 93 is A, I, T or V. In embodiments, the amino acid at position 94 is I, L, M, or F. In embodiments, a combination of or all of these positions are substituted. Example combinations of the substitutions are shown in Tables 5 and 6. In embodiments, such polypeptides have KARI activity.

In other embodiments, polypeptides provided herein comprise at least one amino acid substitution at at least one position corresponding to A73, L167, T191, S32, V220, L243, C46, E200, E68, D14, I234, A311, F189, K42, V158, G45, P124, K42, D196, L284, P101, M132, K270, K77, P125, K136, A162, D242, F115, Q213, Y262, F292, K238, I256, C156, M94, F53, C209, S330, Q91, A210, A157, N107, K294, V56, I25, H235, I84, F189, Y254, V56, G114, E194, L211, D225, A166, L171, T218, G248, K96, V123, F53, M108, E186, D302, E58, G223, T93, G114, G151, D302, K42, K282, I283, G120, T191, Y254, V123, K126, K281, A174, V142, D168, E261, A92, M169, E274, A176, A214, I99, A210, T191, T187, L219, T187, L219, T191, G304, A105, C209, P101, A279, G120, A303, K314, I272, R181, E145, A214, T93, D127, N40, G207, E326, D295, E147, G149, V298, T273, T131, I122, D264, H118, R190, L315, D242, M312, S285, I234, L85, H140, or M237 of SEQ ID NO: 239. In embodiments, polypeptides provided herein comprise substitutions at at least 2 of these positions, at least 3 of these positions, or at at least 4 of these positions. Examples of combinations of such substitutions are provided in Table 11, along with examples of amino acids suitable for substituting at such positions.

In embodiments, polypeptides comprise at least one, at least two, or at least 3 of the following substitutions: T191 N, T191 S, E58D, E274K, T187S, K42N, A105T, A73T, A92D, A279T, A176T, G120S, M169K, R181K, or A214V.

In embodiments, polypeptides comprise a substitution at the position corresponding to position 53 of SEQ ID NO: 93 selected from L, I, M, V, P, S, A, E, or Q. In embodiments, the amino acid at position 53 is F.

In embodiments, polypeptides provided herein comprise one of the following substitutions or a combination thereof: Y53F, S56A, K57E, S58E, N87P, K90A/Y, T93L, M94L, E148Q, H37N, G45C, G66A, E148G, E148Q, V156A, T191S, Y254F, or K278M. In embodiments, polypeptides provided herein comprise substitutions at each of positions corresponding to positions 53, 56, 57, 58, 87, and 90 of SEQ ID NO: 93. In embodiments, the amino acids at the positions are 53F, 56A, 57E, 58E, 87P, 90A/Y. In embodiments, such polypeptides further comprise a substitution at the position corresponding to 93 or 94 or both. In embodiments, the amino acids at these positions are 93L or 94L. Examples of such substitution combinations may include, but are not limited to, the following:

---

53, 56, 57, 58, 87, 90, 93, 94
53, 56, 57, 58, 87, 90, 93, 94, 148
53, 56, 57, 58, 87, 90, 93, 94, 37
53, 56, 57, 58, 87, 90, 93, 94, 45
53, 56, 57, 58, 87, 90, 93, 94, 66
53, 56, 57, 58, 87, 90, 93, 94, 148
53, 56, 57, 58, 87, 90, 93, 94, 156
53, 56, 57, 58, 87, 90, 93, 94, 191
53, 56, 57, 58, 87, 90, 93, 94, 254
53, 56, 57, 58, 87, 90, 93, 94, 278
53, 56, 57, 58, 87, 90, 94, 37
53, 56, 57, 58, 87, 90, 94, 66$^a$
53, 56, 57, 58, 87, 90, 94, 148
53, 56, 57, 58, 87, 90, 94, 156$^a$
53, 56, 57, 58, 87, 90, 94, 191
53, 56, 57, 58, 87, 90, 93
53, 56, 57, 58, 87, 90, 93, 191
53, 56, 57, 58, 87, 90, 93, 94, 258
53, 56, 57, 58, 87, 90, 94, 148

---

Examples of such substitution combinations may include, but are not limited to:

---

Y53F, S56A, K57E, S58E, N87P, K90A, T93L, M94L
Y53F, S56A, K57E, S58E, N87P, K90A, T93L, M94L, E148Q
Y53F, S56A, K57E, S58E, N87P, K90A, T93L, M94L, H37N
Y53F, S56A, K57E, S58E, N87P, K90A, T93L, M94L, G45C
Y53F, S56A, K57E, S58E, N87P, K90A, T93L, M94L, G66A
Y53F, S56A, K57E, S58E, N87P, K90A, T93L, M94L, E148G
Y53F, S56A, K57E, S58E, N87P, K90A, T93L, M94L, V156A
Y53F, S56A, K57E, S58E, N87P, K90A, T93L, M94L, T191S
Y53F, S56A, K57E, S58E, N87P, K90A, T93L, M94L, Y254F
Y53F, S56A, K57E, S58E, N87P, K90A, T93L, M94L, K278M
Y53F, S56A, K57E, S58E, N87P, K90Y, M94L, H37N
Y53F, S56A, K57E, S58E, N87P, K90Y, M94L, G66A
Y53F, S56A, K57E, S58E, N87P, K90Y, M94L, E148Q
Y53F, S56A, K57E, S58E, N87P, K90Y, M94L, V156A
Y53F, S56A, K57E, S58E, N87P, K90Y, M94L, T191S
Y53F, S56A, K57E, S58E, N87P, K90A, T93L
Y53F, S56A, K57E, S58E, N87P, K90A, T93L, T191S
Y53F, S56A, K57E, S58E, N87P, K90A, T93L, M94L, N258S
Y53F, S56A, K57E, S58E, N87P, K90Y, M94L, E148Q

In embodiments, polypeptides comprise substitutions at the amino acids at positions corresponding to positions 158, 67, 162, 312, 169, or a combination thereof. In embodiments, the amino acid at position 158 is T, K, or W. In embodiments, the amino acid at position 67 is L, M, or Q. In embodiments, the amino acid at position 162 is Q, P, H, R, C, N. In embodiments, the amino acid at position 169 is Q, C, T, E, or M. In embodiments, the amino acid at position 312 is C or L.

In embodiments, polypeptides comprise substitutions at the amino acids at positions corresponding to position 53, 56, 57, 58, 87, or a combination thereof. In embodiments, polypeptides further comprise substitutions at positions 87, 147, 164, 304, 258, 71, 184, 79, 98, 169, 100, 312, or combinations thereof. Examples of such substitution combinations may include, but are not limited to, the following:

| |
|---|
| 53, 56, 57, 58, 87 |
| 53, 56, 57, 58, 87, 147 |
| 53, 56, 57, 58, 87, 164 |
| 53, 56, 57, 58, 87, 304 |
| 53, 56, 57, 58, 87, 258 |
| 53, 56, 57, 58, 87, 71 |
| 53, 56, 57, 58, 87, 184 |
| 53, 56, 57, 58, 87, 79 |
| 53, 56, 57, 58, 87, 98 |
| 53, 56, 57, 58, 87, 169 |
| 53, 56, 57, 58, 87, 169 |
| 53, 56, 57, 58, 87, 169 |
| 53, 56, 57, 58, 87, 100, 312 |

Examples of such substitution combinations may include, but are not limited to, the following:

| |
|---|
| Y53L, S56V, K57E, S58E, N87P |
| Y53L, S56V, K57E, S58E, N87P, E147V |
| Y53L, S56V, K57E, S58E, N87P, G164D |
| Y53L, S56V, K57E, S58E, N87P, G304V |
| Y53L, S56V, K57E, S58E, N87P, N258S |
| Y53L, S56V, K57E, S58E, N87P, T71S |
| Y53L, S56V, K57E, S58E, N87P, V184I |
| Y53L, S56V, K57E, S58E, N87P, A79D |
| Y53L, S56V, K57E, S58E, N87P, D98V |
| Y53L, S56V, K57E, S58E, N87P, M169F |
| Y53L, S56V, K57E, S58E, N87P, M169K |
| Y53L, S56V, K57E, S58E, N87P, M169L |
| Y53L, S56V, K57E, S58E, N87P, E100Q, M312K |

In embodiments, a KARI variant having SEQ ID NO: 239 further comprises substitution(s) selected from: A73T; L167M and T191S; S32Y and V220I; L243S; C465 and E200E; E68G; D14N, I234N and A311V; F189L; K42M and V158D; G45D; P124S; K42N, D196V and L284C; P101S, M132V and K270N; K77M; P125S; K136E, A162T and D242V; F115I, Q213H and Y262N; F292I; K238M; I256T and C156V; M94L; F53L, C209S and S330Y; Q91R and A210D; A157S; N107S; F53I and K294M; V56A; I25N and H235Y; I84N and F189Y; Y254H, V56A; G114C, E194D, L211S and D225E; A166T, L171S, T218I and G248C; K96E and V123A; K96E and V123A; F53I and M108L; E186D; F53I; D302E; E58D; G223D; T93A, G114D and G151S; D302E; K42N, K282N and I283F; G120S; T191N and Y254H; V123A and K126M; K281M; A174D; V142F, D168E and E261E; A92D; M169K; E274K; A176T; A214V; I99V and A210T; T191S; T187S; L219W; G304C; A105T; C209R; P101S; A279T; G120S, A303T and K314M; I272N; R181K; E145V and A214T; T93I; D127E; N40D and T191S; G207S and E326K; D295E; E147D; G149C and V298A; T273S; T131A; I122F; D264V; H118Y and R190G; L315M; D264V; D242N; M312I; S285Y; I234M; L85M, H140Y and M237L; and a combination thereof.

In embodiments, a KARI variant having SEQ ID NO: 239 further comprises substitution(s) selected from: F53L; F53I; F53M; F53V; F53P; F53S; F53A; F53E; F53Q; Y53F, S56V, K57E, S58E and N87P; Y53L, S56V, K57E, S58E and N87P; Y53I, S56V, K57E, S58E and N87P; and a combination thereof.

In embodiments, a KARI variant having SEQ ID NO: 239 further comprises substitution(s) selected from: Y53L, S56V, K57E, S58E and N87P; Y53L, S56V, K57E, S58E, N87P and E147V; Y53L, S56V, K57E, S58E, N87P and G164D; Y53L, S56V, K57E, S58E, N87P, and G304V; Y53L, S56V, K57E, S58E, N87P and N258S; Y53L, S56V, K57E, S58E, N87P and T71S; Y53L, S56V, K57E, S58E, N87P and V184I; Y53L, S56V, K57E, S58E, N87P and A79D; Y53L, S56V, K57E, S58E, N87P and D98V; Y53L, S56V, K57E, S58E, N87P and M169F; Y53L, S56V, K57E, S58E, N87P and M169K; Y53L, S56V, K57E, S58E, N87P and M169L; Y53L, S56V, K57E, S58E, N87P, E100Q and M312K; and a combination thereof.

In embodiments, a KARI variant having SEQ ID NO: 239 further comprises substitution(s) selected from those of ECB11, EC2A2, EC2B12, K9SB2_SH, EGC10, EGGS, EGD9, EHG1, EHG2, EHH12, EHH10, EHH6, EHH9, EKC5, EKG4, EJF5, EJA1, EJB8, EJB10; and a combination thereof.

In embodiments, polypeptides provided herein comprise amino acid sequences with at least about 80%, at least about 85%, at least about 90%, at least about 95%, at least about 98% identity to the sequences of K9JM2, K9JM3, K9JM4, K9JM5, K9JM6, K9JM7, K9JM8, K9JM9, K9JM10, K9JM11, K9JM12, K9JM13, K9JM14, K9JM15, K9JM16, K9JM17, K9JM18, K9JM19, K9JM20, K9JM21, K9JM22, K9JM23, K9JM24, K9JM25, K9JM26, K9JM27, K9JM28, K9JM29, K9JM30, K9JM31, JM32, JM33, JM34, JM35, JM36, JM37, JM38, JM39, JM40, JM42, JM43, JM44, K9SB2, K9_DAVID_SH, K9ALL3, K9_URSALA (K9SB2+A56V), JM41, K9ALL148, K9JM148, K9ALL156, K9JM156, K9ALL191, K9JM191, K9ALL254, K9ALL278, K9ALL37, K9JM37S, K9ALL66, K9JM66, K9ALL8Q, K9JM8Q, K9ALL45, K9_LUCY, K9_ILYA, K9ALL258, K9YW25-T191S, PLH689::ALL3, F53L, F53I, F53M, F53V, F53P, F53S, F53A, F53E, F53Q, T11-1, T11-2, T11-3, T11-4, T11-5, T11-6, T11-7, T11-10, T11-12, T11-13, T11-14, T11-15, T11-16, T11-18, T11-19, T11-21, T11-22, T11-25, T11-27, T11-28, T11-29, T11-30, T11-32, T11-33, T11-35, T11-36, T11-37, T11-38, T11-39, T11-42, T11-43, T11-44, T11-45, T11-46, T11-47, T11-49, T11-50, T11-52, T11-54, T11-55, T11-56, T11-57, T11-58, T11-59, T11-60, T11-61, T11-62, T11-64, T11-66, T11-67, T11-69, T11-70, T11-72, T11-74, T11-75, T11-76, T11-79, T11-80, T11-81, T11-83, T11-84, T11-85, T11-86, T11-87, T11-88, T11-91, T11-94, T11-95, T11-96, T11-97, T11-99, T11-103, T11-104, T11-109, T11-110, T11-111, T11-114, T11-116, T11-117, T11-119, T11-121, T11-122, T11-124, T11-125, T11-128, T11-130, T11-131, T11-134, E147V, G164D, G304V, N258S, T71S, V184I, A279D, D98V, M169F, M169K, M169L, E100Q_M312K, ECB11, EC2A2, EC2B12, EGC10, EGD9, EGGS, EHG1, EHG2, EHH6, EHH9, EHH10, EHH12, EKC5, EKG4, EJF5, EJB8, EJA1, EJB10, K9_Lucy_SH, or K9JM1 or an active fragment thereof. Accordingly, in embodiments, polypeptides provided herein comprise amino acid sequences with at least about 80%, at least about 85%, at least about 90%, at least about 95%, at least about 98% identity to the sequences of K9JM36 (SEQ ID NO: 227), K9JM43 (SEQ ID NO: 233), K9JM44 (SEQ ID NO: 234), or K9ALL3 (SEQ ID NO: 237), or an active fragment thereof. In embodiments, polypeptides comprise the sequence of K9JM36 (SEQ ID NO: 227), K9JM43 (SEQ ID NO: 233), K9JM44 (SEQ ID NO: 234), or K9ALL3 (SEQ ID NO: 237), or an active fragment thereof In embodiments, substitutions in KARI enzymes such as that derived from *Anaerostipes caccae* lower the $K_M$ for NADH.

In embodiments, the polypeptides comprise fewer than 10, 15, or 20 substitutions. In embodiments, the polypeptides match the Profile HMM based on experimentally verified KARIs and given in Table Z with an E value less than <10$^{-3}$. Sequences can be compared to the profile HMM given in Table Z using hmmsearch (HMMER software package available from Janelia Farm Research Campus, Ashburn, Va.).

Also provided herein are polynucleotides encoding polypeptides provided herein. Also provided herein are recombinant host cells comprising such polypeptides or polynucleotides and methods comprising such recombinant host cells.

Molecular Techniques

Standard recombinant DNA and molecular cloning techniques used herein are well known in the art and are described by Sambrook, J., Fritsch, E. F. and Maniatis, T., *Molecular Cloning: A Laboratory Manual*, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory Press, Cold Spring Harbor, N.Y. (1984); and by Ausubel, F. M. et al., *Current Protocols in Molecular Biology*, published by Greene Publishing Assoc. and Wiley-Interscience (1987).

Identification of Additional Polypeptides Having KARI Activity

Equipped with this disclosure, one of skill in the art will be readily able to identify additional suitable polypeptides having KARI activity. The sequences of other polynucleotides, genes and/or polypeptides can be identified in the literature and in bioinformatics databases well known to the skilled person using sequences disclosed herein and available in the art. For example, such sequences can be identified through BLAST searching of publicly available databases with polynucleotide or polypeptide sequences provided herein. In such a method, identities can be based on the Clustal W method of alignment using the default parameters of GAP PENALTY=10, GAP LENGTH PENALTY=0.1, and Gonnet 250 series of protein weight matrix.

Additionally, polynucleotide or polypeptide sequences disclosed herein can be used to identify other KARI homologs in nature. For example, each of the KARI encoding nucleic acid fragments disclosed herein can be used to isolate genes encoding homologous proteins. Isolation of homologous genes using sequence-dependent protocols is well known in the art. Examples of sequence-dependent protocols include, but are not limited to (1) methods of nucleic acid hybridization; (2) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor et al., Proc. Acad. Sci. USA 82:1074 (1985); or strand displacement amplification (SDA), Walker et al., Proc. Natl. Acad. Sci. U.S.A., 89:392 (1992)]; and (3) methods of library construction and screening by complementation.

It will be appreciated that one of ordinary skill in the art, equipped with this disclosure, can generate active fragments of polypeptides provided herein, for example, by truncating polypeptides provided herein based on sequence alignments at the N-terminus and confirming KARI activity. In embodiments, *Anaerostipes caccae* KARIs and variants thereof provided herein are truncated at the N-terminus relative to the wild-type sequence (SEQ ID NO: 93).

Generation of Variants

Variants described herein may be generated by any method known in the art. Methods known in the art for site-directed mutagenesis include, for example, QuikChange® (Agilent, Santa Clara, Calif.) and Change-IT® (Affymetrix/USB, Santa Clara, Calif.). Methods known in the art for random point mutagenesis include, for example, error-prone PCR (e.g., Bloom et al., BMC Biol. 2007, 5:29, doi:10.1186/1741-7007-5-29.) or GeneMorph® (Agilent, Santa Clara, Calif.), exposure to chemical mutagens (e.g., ethyl methanesulfonate) or ultraviolet light, use of modified nucleotides in PCR (e.g., Wong et al., Nucleic Acids Res. 2004, 32:3, e26.), and use of special mutator strains. Methods known in the art for DNA recombination or "shuffling" include, for example, random fragmentation and reassembly (e.g. Stemmer 1994 Proc. Natl. Acad. Sci. USA 91:22, 10747-10751.), heteroduplex repair (e.g., Volkov et al., Nucleic Acids Res. 1999 27:18, e18.), staggered extension (e.g., Zhao et al., Nat. Biotechnol. 1998, 16:3, 258-261.), unpaired-primer shuffling (e.g., Milano et al., U.S. Pat. No. 7,879,582), site-directed recombination (e.g., Hiraga et al., J. Mol. Biol. 2003, 330:2, 287-296.), and synthetic shuffling (e.g., Ness et al., Nat. Biotechnol. 2002, 20, 1251-1255.). Other methods for protein variant library construction include, for example, circular permutation (e.g., Guntas et al., PLoS One. 2012, 7(4):e35998), and chemical DNA synthesis. Equipped with this disclosure, one of skill in the art can readily make and use the variants provided herein as well as variants with less than 100% identity (as described above) thereto.

Additional polypeptides having KARI activity can be obtained using methods described and demonstrated herein. For example, a polypeptide having KARI activity can be employed in the construction of a site-saturation gene library as described herein. Kits for construction of such gene libraries are commercially available (for example, from USB Corporation, Cleveland, Ohio, #78480.) Site-directed mutagenesis can also be carried out using commercially available kits (for example, the QuickChange II XL site directed mutagenesis kit, Catalog #200524, Stratagene, La Jolla, Calif.). Primer design for target sites for mutagenesis is well-known in the art, and multiple sequence alignment to identify the target sites is likewise well-known.

Cofactor Specificity

To determine cofactor specificity, $V_{max}/K_M$ ratios may be calculated for each cofactor at saturating acetolactate; those variants with a higher ratio for NADH will react at a higher rate with NADH than NADPH under conditions of equal-molar concentrations of the two cofactors and saturating acetolactate. $V_{max}$ and $K_M$ values for NADH and NADPH can be determined using methods known in the art and/or provided herein. For example, to determine $V_{max}$ and $K_M$ values for NADH and NADPH, the partially purified proteins may be assayed at various concentrations of NADH and NADPH.

KARI Structure

Structural information useful in the identification and modification of polypeptides having KARI activity is provided in art, such as in the references described here as well as in the Profile HMM provided herewith in Table Z and described in US App. Pub. Nos. 20100197519 and 20090163376.

It was reported that phosphate p2' oxygen atoms of NADPH form hydrogen bonds with side chains of Arg162, Ser165 and Ser167 of spinach KARI (Biou V., et al. The EMBO Journal, 16: 3405-3415, 1997). Studies by Ahn et al., (J. Mol. Biol., 328: 505-515, 2003) had identified three NADPH phosphate binding sites (Arg47, Ser50 and Thr52) for *Pseudomonas aeruginosa* (PAO-KARI) following comparing its structure with that of the spinach KARI. The structure of PF5-KARI with bound NADPH, acetolactate and magnesium ions was built based on the crystal structure of *P. aeruginosa* PAO1-KARI (PDB ID 1NP3, Ahn H. J. et al., J. Mol. Biol., 328: 505-515, 2003) which has 92% amino acid sequence homology to PF5 KARI. PAO1-KARI structure is a homo-dodecamer and each dodecamer consists of six homo-dimers with extensive dimer interface. The active site of KARI is located in this dimer interface. The biological assembly is formed by six homo-dimers positioned on the edges of a tetrahedron resulting in a highly symmetrical dodecamer of 23 point group symmetry.

The model of PF5-KARI dimer was built based on the coordinates of monomer A and monomer B of PAO1-KARI and sequence of PF5-KARI using DeepView/Swiss PDB viewer (Guex, N. and Peitsch, M. C., Electrophoresis, 18: 2714-2723, 1997). This model was then imported to program O (Jones, T. A. et al, Acta Crystallogr. A 47: 110-119, 1991) on a Silicon Graphics system for further modification.

The structure of PAO1-KARI has no NADPH, substrate or inhibitor or magnesium in the active site. Therefore, the spinach KARI structure (PDB ID 1yve, Biou V. et al., The EMBO Journal, 16: 3405-3415, 1997.), which has magnesium ions, NADPH and inhibitor (N-Hydroxy-N-isopropyloxamate) in the acetolacate binding site, was used to model these molecules in the active site. The plant KARI has very little sequence homology to either PF5- or PAO1 KARI (<20% amino acid identity), however the structures in the active site region of these two KARI enzymes are very similar. To overlay the active site of these two KARI structures, commands LSQ_ext, LSQ_improve, LSQ_mol in the program O were used to line up the active site of monomer A of spinach KARI to the monomer A of PF5 KARI model. The coordinates of NADPH, two magnesium ions and the inhibitor bound in the active site of spinach KARI were extracted and incorporated to molecule A of PF5 KARI. A set of the coordinates of these molecules were generated for monomer B of PF5 KARI by applying the transformation operator from monomer A to monomer B calculated by the program.

Because there is no NADPH in the active site of PAO1 KARI crystal structure, the structures of the phosphate binding loop region in the NADPH binding site (residues 44-45 in PAO1 KARI, 157-170 in spinach KARI) are very different between the two. To model the NADPH bound form, the model of the PF5-KARI phosphate binding loop (44-55) was replaced by that of 1yve (157-170). Any discrepancy of side chains between these two was converted to those in the PF5-KARI sequence using the mutate_replace command in program O, and the conformations of the replaced side-chains were manually adjusted. The entire NADPH/Mg/inhibitor bound dimeric PF5-KARI model went through one round of energy minimization using program CNX (ACCELRYS San Diego Calif., Burnger, A. T. and Warren, G. L., Acta Crystallogr., D 54: 905-921, 1998) after which the inhibitor was replaced by the substrate, acetolactate (AL), in the model.

KARI Activity

Polypeptides described herein include those with KARI activity. KARI activity can be confirmed by assaying for the enzymatic conversion of acetolactate to 2,3-dihydroxyisovalerate using methods described in the art (for example in U.S. Pat. No. 8,129,162, incorporated herein by reference). For example, the conversion may be followed by measuring the disappearance of the cofactor, NADPH or NADH, from the reaction at 340 nm using a plate reader (such as from Molecular Device, Sunnyvale, Calif.).

KARI activity may also be confirmed by expressing a given KARI in a host cell comprising polynucleotides encoding polypeptides that catalyze the substrate to product conversions given in FIG. 1, steps a, c, d, and e and measuring the production of isobutanol, as described and demonstrated herein (see Examples). Alternatively, KARI activity may be confirmed by measuring the production of intermediate products in the biosynthetic pathway downstream of the substrate to product conversion catalyzed by KARI. Likewise, host cells comprising the substrate to product conversions for other biosynthetic pathways can also be used to confirm KARI activity using a like strategy and confirming the production of the biosynthetic pathway product or intermediate products downstream of the substrate to product conversion catalyzed by KARI.

Once variants have been generated, KARI activity with NADH or NADPH can be readily assessed using methods known in the art and/or disclosed herein. For example, KARI activity may be determined by measuring the disappearance of the NADPH or NADH from the reaction at 340 nm or by determination of the Michaelis constant via measurement of formation of 2,3-dihydroxyisovalerate using HPLC/MS.

Confirmation of Isobutanol Production

The presence and/or concentration of isobutanol in the culture medium can be determined by a number of methods known in the art (see, for example, U.S. Pat. No. 7,851,188, incorporated by reference). For example, a specific high performance liquid chromatography (HPLC) method utilizes a Shodex SH-1011 column with a Shodex SHG guard column, both may be purchased from Waters Corporation (Milford, Mass.), with refractive index (RI) detection. Chromatographic separation is achieved using 0.01 M $H_2SO_4$ as the mobile phase with a flow rate of 0.5 mL/min and a column temperature of 50° C. Isobutanol has a retention time of 46.6 min under the conditions used.

Alternatively, gas chromatography (GC) methods are available. For example, a specific GC method utilizes an HP-INNOWax column (30 m×0.53 mm id, 1 μm film thickness, Agilent Technologies, Wilmington, Del.), with a flame ionization detector (FID). The carrier gas is helium at a flow rate of 4.5 mL/min, measured at 150° C. with constant head pressure; injector split is 1:25 at 200° C.; oven temperature is 45° C. for 1 min, 45 to 220° C. at 10° C./min, and 220° C. for 5 min; and FID detection is employed at 240° C. with 26 mL/min helium makeup gas. The retention time of isobutanol is 4.5 min.

Reduction of DHMB

The production of DHMB in a host cell comprising an isobutanol biosynthetic pathway indicates that not all of the pathway substrates are being converted to the desired product. Thus, yield is lowered. In addition, DHMB can have inhibitory effects on product production. For example, DHMB can decrease the activity of enzymes in the biosynthetic pathway or have other inhibitory effects on yeast growth and/or productivity during fermentation. Thus, the methods described herein provide ways of reducing DHMB during fermentation. The methods include both methods of decreasing the production of DHMB and methods of removing DHMB from fermenting compositions.

Decreasing DHMB Production

In some embodiments described herein, a recombinant host cell can comprise reduced or eliminated ability to convert acetolactate to DHMB. The ability of a host cell to convert acetolactate to DHMB can be reduced or eliminated, for example, by a modification or disruption of a polynucleotide or gene encoding a polypeptide having acetolactate reductase activity or a modification or disruption of a polypeptide having acetolactate reductase activity. In other embodiments, the recombinant host cell can comprise a deletion, mutation, and/or substitution in an endogenous polynucleotide or gene encoding a polypeptide having acetolactate reductase activity or in an endogenous polypeptide having acetolactate reductase. Such modifications, disruptions, deletions, mutations, and/or substitutions can result in acetolactate reductase activity that is reduced, substantially eliminated, or eliminated. In some embodiments of the invention, the product of the biosynthetic pathway is produced at a greater yield or amount compared to the production of the same product in a recombinant host cell that does not comprise reduced or eliminated ability to convert acetolactate to DHMB. In some embodiments, the conversion of acetolactate to DHMB in a recombinant host cell is reduced, substantially eliminated, or eliminated. In some embodiments, the polypeptide having acetolactate reductase activity is selected from the group consisting of: YMR226C, YER081W, YIL074C, YBR006W, YPL275W, YOL059W, YIR036C, YPL061W, YPL088W, YCR105W, YOR375C, and YDR541C.

Thus, the product can be a composition comprising isobutanol that is substantially free of, or free of DHMB. In some embodiments, the composition comprising butanol contains no more than about 5 mM, about 4 mM, about 3 mM, about 2 mM, about 1 mM, about 0.5 mM, about 0.4 mM, about 0.3 mM DHMB, or about 0.2 mM DHMB.

Any product of a biosynthetic pathway that involves the conversion of acetolactate to a substrate other than DHMB can be produced with greater effectiveness in a recombinant host cell disclosed herein having the described modification of acetolactate reductase activity. Such products include, but are not limited to, butanol, e.g., isobutanol, 2-butanol, and BDO, and branched chain amino acids.

In some embodiments, the host cell comprises at least one deletion, mutation, and/or substitution in at least one endogenous polynucleotide encoding a polypeptide having acetolactate reductase activity. In some embodiments, the host cell comprises at least one deletion, mutation, and/or substitution in each of at least two endogenous polynucleotides encoding polypeptides having acetolactate reductase activity.

In some embodiments, a polypeptide having acetolactate reductase activity can catalyze the conversion of acetolactate to DHMB. In some embodiments, a polypeptide having acetolactate reductase activity is capable of catalyzing the reduction of acetolactate to 2S,3S-DHMB (fast DHMB) and/or 2S,3R-DHMB (slow DHMB).

DHMB Removal

In other embodiments, a reduction in DHMB can be achieved by removing DHMB from a fermentation. Thus, fermentations with reduced DHMB concentrations are also described herein. Removal of DHMB can result, for example, in a product of greater purity, or a product requiring less processing to achieve a desired purity. Therefore, compositions comprising products of biosynthetic pathways such as ethanol or butanol with increased purity are also provided.

DHMB can be removed during or after a fermentation process and can be removed by any means known in the art. DHMB can be removed, for example, by extraction into an organic phase or reactive extraction.

In some embodiments, the fermentation broth comprises less than about 0.5 mM DHMB. In some embodiments, the fermentation broth comprises less than about 1.0 mM DHMB after about 5 hours, about 10 hours, about 15 hours, about 20 hours, about 25 hours, about 30 hours, about 35 hours, about 40 hours, about 45 hours, or about 50 hours of fermentation. In some embodiments, the fermentation broth comprises less than about 5.0 mM DHMB after about 20 hours, about 25 hours, about 30 hours, about 35 hours, about 40 hours, about 45 hours, or about 50 hours of fermentation.

Biosynthetic Pathways

While KARI variants presented herein are suitable for production of isobutanol (see Examples), it is envisioned that KARIs disclosed herein may be useful in any biosynthetic pathway which employs a substrate to product conversion catalyzed by KARI activity such as acetolactate to 2,3-dihydroxyisovalerate or 2-aceto-2-hydroxybutanoate to 2,3-dihydroxy-3-methylpentanoate. Such pathways include, but are not limited to, pathways for producing pantothenic acid, valine, leucine, isoleucine or 3,3-dimethylmalate.

In one embodiment, the pathway comprising the substrate to product conversion catalyzed by KARI is a pantothenic acid biosynthetic pathway comprising the following substrate to product conversions:

pyruvate to acetolactate, which may be catalyzed, for example, by acetolactate synthase;

acetolactate to 2,3-dihydroxyisovalerate, which may be catalyzed, for example, by ketol-acid reductoisomerase (KARI);

2,3-dihydroxyisovalerate to α-ketoisovalerate, which may be catalyzed, for example, by dihydroxyacid dehydratase (DHAD);

α-ketoisovalerate to 2-dehydropantoate, which may be catalyzed, for example, by 3-methyl-2-oxobutanoate hydroxymethyltransferase (panB; which may be classified as EC 2.1.2.11);

2-dehydropantoate to (R)-pantoate, which may be catalyzed, for example by 2-dehydropantoate 2-reductase (panE; which may be classified as EC 1.1.1.169)

(R)-pantoate to (R)-pantothenate. which may be catalyzed, for example, by pantoate-beta-alanine ligase (panC; which may be classified as EC 6.3.2.1).

In another embodiment, the pathway comprising a substrate to product conversion catalyzed by KARI is a valine biosynthetic pathway comprising the following substrate to product conversions:

pyruvate to acetolactate, which may be catalyzed, for example, by acetolactate synthase;

acetolactate to 2,3-dihydroxyisovalerate, which may be catalyzed, for example, by ketol-acid reductoisomerase (KARI);

2,3-dihydroxyisovalerate to α-ketoisovalerate, which may be catalyzed, for example, by dihydroxyacid dehydratase (DHAD);

α-ketoisovalerate to valine, which may be catalyzed, for example, by branched chain aminotransferase (ilvE (BAT); which may be classified as EC 2.6.1.42).

In another embodiment, the pathway comprising a substrate to product conversion catalyzed by KARI is an isoleucine biosynthetic pathway comprising the following substrate to product conversions:
- pyruvate and α-ketobutyrate to 2-aceto-2-hydroxybutanoate, which may be catalyzed for example, by acetolactate synthase;
- 2-aceto-2-hydroxybutanoate to 2,3-dihydroxy-3-methylpentanoate, which may be catalyzed for example, by KARI;
- 2,3-dihydroxy-3-methylpentanoate to 3-methyl-2-oxopentanoate, which may be catalyzed for example, by DHAD;
- 3-methyl-2-oxo-pentanoate to isoleucine, which may be catalyzed, for example, by branched chain aminotransferase (ilvE (BAT); which may be classified as EC 2.6.1.42).

In another embodiment, the pathway comprising a substrate to product conversion catalyzed by KARI is a leucine biosynthetic pathway comprising the following substrate to product conversions:
- pyruvate to acetolactate, which may be catalyzed, for example, by acetolactate synthase;
- acetolactate to 2,3-dihydroxyisovalerate, which may be catalyzed, for example, by ketol-acid reductoisomerase (KARI);
- 2,3-dihydroxyisovalerate to α-ketoisovalerate, which may be catalyzed, for example, by dihydroxyacid dehydratase (DHAD);
- α-ketoisovalerate to 2-isopropylmalate, which may be catalyzed, for example, by 2-isopropylmalate synthase (leuA, which may be classified as EC 2.3.3.13);
- 2-isopropylmalate to 2-isopropylmaleate, which may be catalyzed, for example, by 3-isopropylmalate dehydratase (leu1; which may be classified as EC 4.2.1.33);
- 2-isopropylmaleate to 3-isopropylmalate, which may be catalyzed, for example, by 3-isopropylmalate dehydratase (leu1; which may be classified as EC 4.2.1.33);
- 3-isopropylmalate to 2-isopropyl-3-oxosuccinate, which may be catalyzed, for example by 3-isopropylmalate dehydrogenase (leuB; which may be classified as EC 1.1.1.85);
- 2-isopropyl-3-oxosuccinate to 4-methyl-2-oxopentanoate (spontaneous reaction); and
- 4-methyl-2-oxopentanoate to leucine, which may be catalyzed, for example, by branched chain aminotransferase (ilvE (BAT); which may be classified as EC 2.6.1.42)

In another embodiment, the pathway comprising a substrate to product conversion catalyzed by KARI is a 3,3-dimethylmalate biosynthetic pathway comprising the following substrate to product conversions:
- pyruvate to acetolactate, which may be catalyzed, for example, by acetolactate synthase;
- acetolactate to 2,3-dihydroxyisovalerate, which may be catalyzed, for example, by ketol-acid reductoisomerase (KARI);
- 2,3-dihydroxyisovalerate to α-ketoisovalerate, which may be catalyzed, for example, by dihydroxyacid dehydratase (DHAD);
- α-ketoisovalerate to (R)-3,3 dimethylmalate, which may be catalyzed for example, by dimethylmalatedehydrogenase (DMMD; which may be classified as 1.1.1.84).

Isobutanol Biosynthetic Pathways

Certain suitable isobutanol biosynthetic pathways are disclosed in U.S. Patent Application Publication No. US 20070092957, which is incorporated by reference herein. A diagram of the disclosed isobutanol biosynthetic pathways is provided in FIG. 1. As described in U.S. Patent Application Publication No. US 20070092957 A1, which is incorporated by reference herein, steps in an example isobutanol biosynthetic pathway include conversion of:
- pyruvate to acetolactate (see FIG. 1, pathway step a therein), as catalyzed for example by acetolactate synthase;
- acetolactate to 2,3-dihydroxyisovalerate (see FIG. 1, pathway step b therein) as catalyzed for example by KARI;
- 2,3-dihydroxyisovalerate to 2-ketoisovalerate (see FIG. 1, pathway step c therein) as catalyzed for example by acetohydroxy acid dehydratase, also called dihydroxy-acid dehydratase (DHAD);
- 2-ketoisovalerate to isobutyraldehyde (see FIG. 1, pathway step d therein) as catalyzed for example by branched-chain 2-keto acid decarboxylase, also referred to as ketoisovalerate decarboxylase ("kivD"); and
- isobutyraldehyde to isobutanol (see FIG. 1, pathway step e therein) as catalyzed for example by branched-chain alcohol dehydrogenase.

Steps in another example isobutanol biosynthetic pathway include conversion of:
i) pyruvate to acetolactate, (pathway step a)
ii) acetolactate to 2,3-dihydroxyisovalerate, (pathway step b)
iii) 2,3-dihydroxyisovalerate to α-ketoisovalerate, (pathway step c)
iv) α-ketoisovalerate to isobutyryl-CoA, (pathway step f)
v) isobutyryl-CoA to isobutyraldehyde, (pathway step g), and
vi) isobutyraldehyde to isobutanol; (pathway step e)

Steps in another example isobutanol biosynthetic pathway include conversion of:
i) pyruvate to acetolactate, (pathway step a)
ii) acetolactate to 2,3-dihydroxyisovalerate, (pathway step b)
iii) 2,3-dihydroxyisovalerate to α-ketoisovalerate, (pathway step c)
iv) α-ketoisovalerate to valine, (pathway step h)
v) valine to isobutylamine, (pathway step i)
vi) isobutylamine to isobutyraldehyde, (pathway step j), and
vii) isobutyraldehyde to isobutanol: (pathway step e)

The substrate to product conversions for steps f, g, h, i, j, and k of alternative pathways are described in U.S. Patent Application Publication No. US 2007/0092957 A1, which is incorporated by reference herein. Genes and polypeptides that can be used for the substrate to product conversions described above as well as those for additional isobutanol pathways, are described in U.S. Patent Appl. Pub. No. 20070092957 and PCT Pub. No. WO 2011/019894, both incorporated by reference herein. US Appl. Pub. Nos. 2011/019894, 20070092957, 20100081154, describe dihydroxy-acid dehydratases including those from *Lactococcus lactis* and *Streptococcus mutans*. Ketoisovalerate decarboxylases include those derived from *Lactococcus lactis*, *Macrococcus caseolyticus* (SEQ ID NO: 542) and *Listeria grayi* (SEQ ID NO: 543).U.S. Patent Appl. Publ. No. 2009/0269823 and U.S. Appl. Publ. No. 20110269199, incorporated by reference, describe alcohol dehydrogenases. Alcohol dehydrogenases include SadB from *Achromobacter xylosoxidans*. Additional alcohol dehydrogenases include horse liver ADH and *Beijerinkia indica* ADH, and those that utilize NADH as a cofactor. In one embodiment a butanol biosynthetic pathway comprises a) a ketol-acid reductoisomerase that has a $K_M$ for NADH less than about 300 μM, less than about 100 μM, less than about 50 μM, less than about 20 μM or less than about 10 μM; b) an alcohol dehydrogenase that utilizes NADH as a cofactor; or c) both a) and b)).

Additionally described in U.S. Patent Application Publication No. US 20070092957 A1, which is incorporated by reference herein, are construction of chimeric genes and genetic engineering of bacteria and yeast for isobutanol production using the disclosed biosynthetic pathways.

Modifications

Functional deletion of the pyruvate decarboxylase gene has been used to increase the availability of pyruvate for utilization in biosynthetic product pathways. For example, U.S. Application Publication No. US 2007/0031950 A1 discloses a yeast strain with a disruption of one or more pyruvate decarboxylase genes and expression of a D-lactate dehydrogenase gene, which is used for production of D-lactic acid. U.S. Application Publication No. US 2005/0059136 A1 discloses glucose tolerant two carbon source independent (GCSI) yeast strains with no pyruvate decarboxylase activity, which may have an exogenous lactate dehydrogenase gene. Nevoigt and Stahl (*Yeast* 12:1331-1337 (1996)) describe the impact of reduced pyruvate decarboxylase and increased NAD-dependent glycerol-3-phosphate dehydrogenase in *Saccharomyces cerevisiae* on glycerol yield. U.S. Appl. Pub. No. 20090305363 discloses increased conversion of pyruvate to acetolactate by engineering yeast for expression of a cytosol-localized acetolactate synthase and substantial elimination of pyruvate decarboxylase activity.

Examples of additional modifications that may be useful in cells provided herein include modifications to reduce glycerol-3-phosphate dehydrogenase activity and/or disruption in at least one gene encoding a polypeptide having pyruvate decarboxylase activity or a disruption in at least one gene encoding a regulatory element controlling pyruvate decarboxylase gene expression as described in U.S. Patent Appl. Pub. No. 20090305363 (incorporated herein by reference), modifications to a host cell that provide for increased carbon flux through an Entner-Doudoroff Pathway or reducing equivalents balance as described in U.S. Patent Appl. Pub. No. 20100120105 (incorporated herein by reference). Other modifications include integration of at least one polynucleotide encoding a polypeptide that catalyzes a step in a pyruvate-utilizing biosynthetic pathway. Other modifications include at least one deletion, mutation, and/or substitution in an endogenous polynucleotide encoding a polypeptide having acetolactate reductase activity as described in U.S. application Ser. No. 13/428,585, filed Mar. 23, 2012, incorporated herein by reference. In embodiments, the polypeptide having acetolactate reductase activity is YMR226C of *Saccharomyces cerevisae* or a homolog thereof. Additional modifications include a deletion, mutation, and/or substitution in an endogenous polynucleotide encoding a polypeptide having aldehyde dehydrogenase and/or aldehyde oxidase activity U.S. application Ser. No. 13/428,585, filed Mar. 23, 2012, incorporated herein by reference. In embodiments, the polypeptide having aldehyde dehydrogenase activity is ALD6 from *Saccharomyces cerevisiae* or a homolog thereof. A genetic modification which has the effect of reducing glucose repression wherein the yeast production host cell is pdc- is described in U.S. Appl. Publ No. US 20110124060.

WIPO publication number WO/2001/103300 discloses recombinant host cells comprising (a) at least one heterologous polynucleotide encoding a polypeptide having dihydroxy-acid dehydratase activity; and (b) (i) at least one deletion, mutation, and/or substitution in an endogenous gene encoding a polypeptide affecting Fe—S cluster biosynthesis; and/or (ii) at least one heterologous polynucleotide encoding a polypeptide affecting Fe—S cluster biosynthesis. In embodiments, the polypeptide affecting Fe—S cluster biosynthesis is encoded by AFT1, AFT2, FRA2, GRX3, or CCC1. In embodiments, the polypeptide affecting Fe—S cluster biosynthesis is constitutive mutant AFT1 L99A, AFT1 L102A, AFT1 C291F, or AFT1 C293F.

Additionally, host cells may comprise heterologous polynucleotides encoding a polypeptides with phosphoketolase activity and/or a heterologous polynucleotide encoding a polypeptide with phosphotransacetylase activity.

Microbial Hosts for Isobutanol Production

Microbial hosts for isobutanol production may be selected from bacteria, cyanobacteria, filamentous fungi and yeasts. The microbial host used for isobutanol production should be tolerant to isobutanol so that the yield is not limited by butanol toxicity. Microbes that are metabolically active at high titer levels of isobutanol are not well known in the art. Although butanol-tolerant mutants have been isolated from solventogenic *Clostridia*, little information is available concerning the butanol tolerance of other potentially useful bacterial strains. Most of the studies on the comparison of alcohol tolerance in bacteria suggest that butanol is more toxic than ethanol (de Cavalho, et al., Microsc. Res. Tech., 64: 215-22, 2004) and (Kabelitz, et al., FEMS Microbiol. Lett., 220: 223-227, 2003, Tomas, et al., J. Bacteriol., 186: 2006-2018, 2004) report that the yield of 1-butanol during fermentation in *Clostridium acetobutylicum* may be limited by 1-butanol toxicity. The primary effect of 1-butanol on *Clostridium acetobutylicum* is disruption of membrane functions (Hermann et al., Appl. Environ. Microbiol., 50: 1238-1243, 1985).

The microbial hosts selected for the production of isobutanol should be tolerant to isobutanol and should be able to convert carbohydrates to isobutanol. The criteria for selection of suitable microbial hosts include the following: intrinsic tolerance to isobutanol, high rate of glucose utilization, availability of genetic tools for gene manipulation, and the ability to generate stable chromosomal alterations.

Suitable host strains with a tolerance for isobutanol may be identified by screening based on the intrinsic tolerance of the strain. The intrinsic tolerance of microbes to isobutanol may be measured by determining the concentration of isobutanol that is responsible for 50% inhibition of the growth rate (IC50) when grown in a minimal medium. The IC50 values may be determined using methods known in the art. For example, the microbes of interest may be grown in the presence of various amounts of isobutanol and the growth rate monitored by measuring the optical density at 600 nanometers. The doubling time may be calculated from the logarithmic part of the growth curve and used as a measure of the growth rate. The concentration of isobutanol that produces 50% inhibition of growth may be determined from a graph of the percent inhibition of growth versus the isobutanol concentration. Preferably, the host strain should have an IC50 for isobutanol of greater than about 0.5%.

The microbial host for isobutanol production should also utilize glucose at a high rate. Most microbes are capable of metabolizing carbohydrates. However, certain environmental microbes cannot metabolize carbohydrates to high efficiency, and therefore would not be suitable hosts.

The ability to genetically modify the host is essential for the production of any recombinant microorganism. The mode of gene transfer technology may be by electroporation, conjugation, transduction or natural transformation. A broad range of host conjugative plasmids and drug resistance markers are available. The cloning vectors are tailored to the host microorganisms based on the nature of antibiotic resistance markers that can function in that host.

The microbial host also has to be manipulated in order to inactivate competing pathways for carbon flow by deleting various genes. This requires the availability of either transposons to direct inactivation or chromosomal integration vectors. Additionally, the production host should be amenable to chemical mutagenesis so that mutations to improve intrinsic isobutanol tolerance may be obtained.

Based on the criteria described above, suitable microbial hosts for the production of isobutanol include, but are not limited to, members of the genera *Clostridium, Zymomonas, Escherichia, Salmonella, Rhodococcus, Pseudomonas, Bacillus, Vibrio, Lactobacillus, Enterococcus, Alcaligenes, Klebsiella, Paenibacillus, Arthrobacter, Corynebacterium, Brevibacterium, Pichia, Candida, Issatchenkia, Hansenula, Kluyveromyces*, and *Saccharomyces*. Suitable hosts include: *Escherichia coli, Alcaligenes eutrophus, Bacillus licheniformis, Paenibacillus macerans, Rhodococcus erythropolis, Pseudomonas putida, Lactobacillus plantarum, Enterococcus faecium, Enterococcus gallinarium, Enterococcus faecalis, Bacillus subtilis* and *Saccharomyces cerevisiae*. In some embodiments, the host cell is *Saccharomyces cerevisiae*. *S. cerevisiae* yeast are known in the art and are available from a variety of sources, including, but not limited to, American Type Culture Collection (Rockville, Md.), Centraalbureau voor Schimmelcultures (CBS) Fungal Biodiversity Centre, LeSaffre, Gert Strand AB, Ferm Solutions, North American Bioproducts, Martrex, and Lallemand. *S. cerevisiae* include, but are not limited to, BY4741, CEN.PK 113-7D, Ethanol Red® yeast, Ferm Pro™ yeast, Bio-Ferm® XR yeast, Gert Strand Prestige Batch Turbo alcohol yeast, Gert Strand Pot Distillers yeast, Gert Strand Distillers Turbo yeast, FerMax™ Green yeast, FerMax™ Gold yeast, Thermosacc® yeast, BG-1, PE-2, CAT-1, CBS7959, CBS7960, and CBS7961.

Construction of Production Host

Recombinant microorganisms containing the necessary genes that will encode the enzymatic pathway for the conversion of a fermentable carbon substrate to isobutanol may be constructed using techniques well known in the art. In the present invention, genes encoding the enzymes of one of the isobutanol biosynthetic pathways of the invention, for example, acetolactate synthase, acetohydroxy acid isomeroreductase, acetohydroxy acid dehydratase, branched-chain α-keto acid decarboxylase, and branched-chain alcohol dehydrogenase, may be isolated from various sources, as described above.

Methods of obtaining desired genes from a bacterial genome are common and well known in the art of molecular biology. For example, if the sequence of the gene is known, suitable genomic libraries may be created by restriction endonuclease digestion and may be screened with probes complementary to the desired gene sequence. Once the sequence is isolated, the DNA may be amplified using standard primer-directed amplification methods such as polymerase chain reaction (U.S. Pat. No. 4,683,202) to obtain amounts of DNA suitable for transformation using appropriate vectors. Tools for codon optimization for expression in a heterologous host are readily available. Some tools for codon optimization are available based on the GC content of the host microorganism.

Once the relevant pathway genes are identified and isolated they may be transformed into suitable expression hosts by means well known in the art. Vectors or cassettes useful for the transformation of a variety of host cells are common and commercially available from companies such as EPICENTRE® (Madison, Wis.), Invitrogen Corp. (Carlsbad, Calif.), Stratagene (La Jolla, Calif.), and New England Biolabs, Inc. (Beverly, Mass.). Typically the vector or cassette contains sequences directing transcription and translation of the relevant gene, a selectable marker, and sequences allowing autonomous replication or chromosomal integration. Suitable vectors comprise a region 5' of the gene which harbors transcriptional initiation controls and a region 3' of the DNA fragment which controls transcriptional termination. Both control regions may be derived from genes homologous to the transformed host cell, although it is to be understood that such control regions may also be derived from genes that are not native to the specific species chosen as a production host.

Initiation control regions or promoters, which are useful to drive expression of the relevant pathway coding regions in the desired host cell are numerous and familiar to those skilled in the art. Virtually any promoter capable of driving these genetic elements, including those used in the Examples, is suitable for the present invention including, but not limited to, CYC1, HIS3, GAL1, GAL10, ADH1, PGK, PHO5, GAPDH, ADC1, TRP1, URA3, LEU2, ENO, TPI (useful for expression in *Saccharomyces*); AOX1 (useful for expression in *Pichia*); and lac, ara, tet, trp, $IP_L$, $IP_R$, T7, tac, and trc (useful for expression in *Escherichia coli, Alcaligenes*, and *Pseudomonas*) as well as the amy, apr, npr promoters and various phage promoters useful for expression in *Bacillus subtilis, Bacillus licheniformis*, and *Paenibacillus macerans*. For yeast recombinant host cells, a number of promoters can be used in constructing expression cassettes for genes, including, but not limited to, the following constitutive promoters suitable for use in yeast: FBA1, TDH3 (GPD), ADH1, ILV5, and GPM1; and the following inducible promoters suitable for use in yeast: GAL1, GAL10, OLE1, and CUP1. Other yeast promoters include hybrid promoters UAS(PGK1)-FBA1p, UAS(PGK1)-ENO2p, UAS(FBA1)-PDC1p, UAS(PGK1)-PDC1p, and UAS(PGK)-OLE1p, described in U.S. application Ser. No. 13/428,585, filed Mar. 23, 2012, incorporated herein by reference.

Termination control regions may also be derived from various genes native to the preferred hosts. Optionally, a termination site may be unnecessary, however, it is most preferred if included.

Certain vectors are capable of replicating in a broad range of host bacteria and can be transferred by conjugation. The complete and annotated sequence of pRK404 and three related vectors-pRK437, pRK442, and pRK442(H) are available. These derivatives have proven to be valuable tools for genetic manipulation in Gram-negative bacteria (Scott et al., Plasmid, 50: 74-79, 2003). Several plasmid derivatives of broad-host-range Inc P4 plasmid RSF1010 are also available with promoters that can function in a range of Gram-negative bacteria. Plasmid pAYC36 and pAYC37, have active promoters along with multiple cloning sites to allow for the heterologous gene expression in Gram-negative bacteria.

Chromosomal gene replacement tools are also widely available. For example, a thermosensitive variant of the broad-host-range replicon pWV101 has been modified to construct a plasmid pVE6002 which can be used to effect gene replacement in a range of Gram-positive bacteria (Maguin et al., J. Bacteriol., 174: 5633-5638, 1992). Additionally, in vitro transposomes are available to create random mutations in a variety of genomes from commercial sources such as EPICENTRE®.

The expression of an isobutanol biosynthetic pathway in various microbial hosts is described in more detail below. Expression of an Isobutanol Biosynthetic Pathway in *E. coli*

Vectors or cassettes useful for the transformation of *E. coli* are common and commercially available from the companies listed above. For example, the genes of an isobutanol biosynthetic pathway may be isolated from various sources, cloned into a modified pUC19 vector and transformed into *E. coli* NM522.

Expression of an Isobutanol Biosynthetic Pathway in *Rhodococcus erythropolis*

A series of *E. coli-Rhodococcus* shuttle vectors are available for expression in *R. erythropolis*, including, but not limited to, pRhBR17 and pDA71 (Kostichka et al., Appl. Microbiol. Biotechnol., 62: 61-68, 2003). Additionally, a series of promoters are available for heterologous gene expression in *R. erythropolis* (Nakashima et al., Appl. Environ. Microbiol., 70: 5557-5568, 2004 and Tao et al., Appl. Microbiol. Biotechnol., 68: 346-354, 2005). Targeted gene disruption of chromosomal genes in *R. erythropolis* may be created using the method described by Tao et al., supra, and Brans et al. (Appl. Environ. Microbiol., 66: 2029-2036, 2000).

The heterologous genes required for the production of isobutanol, as described above, may be cloned initially in pDA71 or pRhBR71 and transformed into *E. coli*. The vectors may then be transformed into *R. erythropolis* by electroporation, as described by Kostichka et al., supra. The recombinants may be grown in synthetic medium containing glucose and the production of isobutanol can be followed using methods known in the art.

Expression of an Isobutanol Biosynthetic Pathway in *B. subtilis*

Methods for gene expression and creation of mutations in *B. subtilis* are also well known in the art. For example, the genes of an isobutanol biosynthetic pathway may be isolated from various sources, cloned into a modified pUC19 vector and transformed into *Bacillus subtilis* BE1010. Additionally, the five genes of an isobutanol biosynthetic pathway can be split into two operons for expression. The three genes of the pathway (bubB, ilvD, and kivD) can be integrated into the chromosome of *Bacillus subtilis* BE1010 (Payne, et al., J. Bacteriol., 173, 2278-2282, 1991). The remaining two genes (ilvC and bdhB) can be cloned into an expression vector and transformed into the *Bacillus* strain carrying the integrated isobutanol genes Expression of an Isobutanol Biosynthetic Pathway in *B. licheniformis*

Most of the plasmids and shuttle vectors that replicate in *B. subtilis* may be used to transform *B. licheniformis* by either protoplast transformation or electroporation. The genes required for the production of isobutanol may be cloned in plasmids pBE20 or pBE60 derivatives (Nagarajan et al., Gene, 114: 121-126, 1992). Methods to transform *B. licheniformis* are known in the art (Fleming et al. Appl. Environ. Microbiol., 61: 3775-3780, 1995). The plasmids constructed for expression in *B. subtilis* may be transformed into *B. licheniformis* to produce a recombinant microbial host that produces isobutanol.

Expression of an Isobutanol Biosynthetic Pathway in *Paenibacillus macerans*

Plasmids may be constructed as described above for expression in *B. subtilis* and used to transform *Paenibacillus macerans* by protoplast transformation to produce a recombinant microbial host that produces isobutanol.

Expression of the Isobutanol Biosynthetic Pathway in *Alcaligenes (Ralstonia) eutrophus*

Methods for gene expression and creation of mutations in *Alcaligenes eutrophus* are known in the art (Taghavi et al., Appl. Environ. Microbiol., 60: 3585-3591, 1994). The genes for an isobutanol biosynthetic pathway may be cloned in any of the broad host range vectors described above, and electroporated to generate recombinants that produce isobutanol. The poly(hydroxybutyrate) pathway in *Alcaligenes* has been described in detail, a variety of genetic techniques to modify the *Alcaligenes eutrophus* genome is known, and those tools can be applied for engineering an isobutanol biosynthetic pathway.

Expression of an Isobutanol Biosynthetic Pathway in *Pseudomonas putida*

Methods for gene expression in *Pseudomonas putida* are known in the art (see for example Ben-Bassat et al., U.S. Pat. No. 6,586,229, which is incorporated herein by reference). The butanol pathway genes may be inserted into pPCU18 and this ligated DNA may be electroporated into electrocompetent *Pseudomonas putida* DOT-T1 C5aAR1 cells to generate recombinants that produce isobutanol.

Expression of an Isobutanol Biosynthetic Pathway in *Saccharomyces cerevisiae*

Methods for gene expression in *Saccharomyces cerevisiae* are known in the art (e.g., *Methods in Enzymology*, Volume 194, *Guide to Yeast Genetics and Molecular and Cell Biology*, Part A, 2004, Christine Guthrie and Gerald R. Fink, eds., Elsevier Academic Press, San Diego, Calif.). Expression of genes in yeast typically requires a promoter, followed by the gene of interest, and a transcriptional terminator. A number of yeast promoters, including those used in the Examples herein, can be used in constructing expression cassettes for genes encoding an isobutanol biosynthetic pathway, including, but not limited to constitutive promoters FBA, GPD, ADH1, and GPM, and the inducible promoters GAL1, GAL10, and CUP1. Suitable transcriptional terminators include, but are not limited to FBAt, GPDt, GPMt, ERG10t, GAL1t, CYC1, and ADH1. For example, suitable promoters, transcriptional terminators, and the genes of an isobutanol biosynthetic pathway may be cloned into *E. coli*-yeast shuttle vectors and transformed into yeast cells as described in U.S. App. Pub. No. 20100129886. These vectors allow strain propagation in both *E. coli* and yeast strains. Typically the vector contains a selectable marker and sequences allowing autonomous replication or chromosomal integration in the desired host. Typically used plasmids in yeast are shuttle vectors pRS423, pRS424, pRS425, and pRS426 (American Type Culture Collection, Rockville, Md.), which contain an *E. coli* replication origin (e.g., pMB1), a yeast 2µ origin of replication, and a marker for nutritional selection. The selection markers for these four vectors are His3 (vector pRS423), Trp1 (vector pRS424), Leu2 (vector pRS425) and Ura3 (vector pRS426). Construction of expression vectors with genes encoding polypeptides of interest may be performed by either standard molecular cloning techniques in *E. coli* or by the gap repair recombination method in yeast.

The gap repair cloning approach takes advantage of the highly efficient homologous recombination in yeast. Typically, a yeast vector DNA is digested (e.g., in its multiple cloning site) to create a "gap" in its sequence. A number of insert DNAs of interest are generated that contain a≥21 bp sequence at both the 5' and the 3' ends that sequentially overlap with each other, and with the 5' and 3' terminus of the vector DNA. For example, to construct a yeast expression vector for "Gene X', a yeast promoter and a yeast terminator are selected for the expression cassette. The promoter and terminator are amplified from the yeast genomic DNA, and Gene X is either PCR amplified from its source organism or obtained from a cloning vector comprising Gene X sequence. There is at least a 21 bp overlapping sequence between the 5' end of the linearized vector and the promoter sequence, between the promoter and Gene X, between Gene X and the terminator sequence, and between the terminator and the 3' end of the linearized vector. The "gapped" vector and the insert DNAs are then co-transformed into a yeast strain and plated on the medium containing the appropriate compound mixtures that allow complementation of the nutritional selection markers on the plasmids.

The presence of correct insert combinations can be confirmed by PCR mapping using plasmid DNA prepared from the selected cells. The plasmid DNA isolated from yeast (usually low in concentration) can then be transformed into an *E. coli* strain, e.g. TOP10, followed by mini preps and restriction mapping to further verify the plasmid construct. Finally the construct can be verified by sequence analysis.

Like the gap repair technique, integration into the yeast genome also takes advantage of the homologous recombination system in yeast. Typically, a cassette containing a coding region plus control elements (promoter and terminator) and auxotrophic marker is PCR-amplified with a high-fidelity DNA polymerase using primers that hybridize to the cassette and contain 40-70 base pairs of sequence homology to the regions 5' and 3' of the genomic area where insertion is desired. The PCR product is then transformed into yeast and plated on medium containing the appropriate compound mixtures that allow selection for the integrated auxotrophic marker. For example, to integrate "Gene X" into chromosomal location "Y", the promoter-coding regionX-terminator construct is PCR amplified from a plasmid DNA construct and joined to an autotrophic marker (such as URA3) by either SOE PCR or by common restriction digests and cloning. The full cassette, containing the promoter-coding regionX-terminator-URA3 region, is PCR amplified with primer sequences that contain 40-70 bp of homology to the regions 5' and 3' of location "Y" on the yeast chromosome. The PCR product is transformed into yeast and selected on growth media lacking uracil. Transformants can be verified either by colony PCR or by direct sequencing of chromosomal DNA.

Expression of an Isobutanol Biosynthetic Pathway in *Lactobacillus plantarum*

The *Lactobacillus* genus belongs to the Lactobacillales family and many plasmids and vectors used in the transformation of *Bacillus subtilis* and *Streptococcus* may be used for *Lactobacillus*. Non-limiting examples of suitable vectors include pAMβ1 and derivatives thereof (Renault et al., Gene 183:175-182, 1996); and (O'Sullivan et al., Gene, 137: 227-231, 1993); pMBB1 and pHW800, a derivative of pMBB1 (Wyckoff et al., Appl. Environ. Microbiol., 62: 1481-1486, 1996); pMG1, a conjugative plasmid (Tanimoto et al., J. Bacteriol., 184: 5800-5804, 2002); pNZ9520 (Kleerebezem et al., Appl. Environ. Microbiol., 63: 4581-4584, 1997); pAM401 (Fujimoto et al., Appl. Environ. Microbiol., 67: 1262-1267, 2001); and pAT392 (Arthur et al., Antimicrob. Agents Chemother., 38: 1899-1903, 1994). Several plasmids from *Lactobacillus plantarum* have also been reported (van Kranenburg R, et al. Appl. Environ. Microbiol., 71: 1223-1230, 2005).

Expression of an Isobutanol Biosynthetic Pathway in Various *Enterococcus* Species (*E. faecium, E. gallinarium*, and *E. faecalis*)

The *Enterococcus* genus belongs to the Lactobacillales family and many plasmids and vectors used in the transformation of Lactobacilli, Bacilli and Streptococci species may be used for *Enterococcus* species. Non-limiting examples of suitable vectors include pAMβ1 and derivatives thereof (Renault et al., Gene, 183: 175-182, 1996); and (O'Sullivan et al., Gene, 137: 227-231, 1993); pMBB1 and pHW800, a derivative of pMBB1 (Wyckoff et al. Appl. Environ. Microbiol., 62: 1481-1486, 1996); pMG1, a conjugative plasmid (Tanimoto et al., J. Bacteriol., 184: 5800-5804, 2002); pNZ9520 (Kleerebezem et al., Appl. Environ. Microbiol., 63: 4581-4584, 1997); pAM401 (Fujimoto et al., Appl. Environ. Microbiol., 67: 1262-1267, 2001); and pAT392 (Arthur et al., Antimicrob. Agents Chemother., 38: 1899-1903, 1994). Expression vectors for *E. faecalis* using the nisA gene from *Lactococcus* may also be used (Eichenbaum et al., Appl. Environ. Microbiol., 64: 2763-2769, 1998). Additionally, vectors for gene replacement in the *E. faecium* chromosome may be used (Nallaapareddy et al., Appl. Environ. Microbiol., 72: 334-345, 2006).

Fermentation Media

Fermentation media in the present invention must contain suitable carbon substrates. Suitable substrates may include but are not limited to monosaccharides such as glucose and fructose, oligosaccharides such as lactose or sucrose, polysaccharides such as starch or cellulose or mixtures thereof and unpurified mixtures from renewable feedstocks such as cheese whey permeate, cornsteep liquor, sugar beet molasses, and barley malt. Additionally the carbon substrate may also be one-carbon substrates such as carbon dioxide, or methanol for which metabolic conversion into key biochemical intermediates has been demonstrated. In addition to one and two carbon substrates methylotrophic microorganisms are also known to utilize a number of other carbon containing compounds such as methylamine, glucosamine and a variety of amino acids for metabolic activity. For example, methylotrophic yeast are known to utilize the carbon from methylamine to form trehalose or glycerol (Bellion et al., *Microb. Growth C1 Compd.*, [Int. Symp.], 7th (1993), 415-32. (eds): Murrell, J. Collin; Kelly, Don P. Publisher: Intercept, Andover, UK). Similarly, various species of *Candida* will metabolize alanine or oleic acid (Sulter et al., Arch. Microbiol., 153: 485-489, 1990). Hence it is contemplated that the source of carbon utilized in the present invention may encompass a wide variety of carbon containing substrates and will only be limited by the choice of microorganism.

Although it is contemplated that all of the above mentioned carbon substrates and mixtures thereof are suitable in the present invention, preferred carbon substrates are glucose, fructose, and sucrose.

In addition to an appropriate carbon source, fermentation media must contain suitable minerals, salts, cofactors, buffers and other components, known to those skilled in the art, suitable for growth of the cultures and promotion of the enzymatic pathway necessary for isobutanol production.

Culture Conditions

Typically cells are grown at a temperature in the range of about 25° C. to about 40° C. in an appropriate medium. Suitable growth media in the present invention are common commercially prepared media such as Luria Bertani (LB) broth, Sabouraud Dextrose (SD) broth or Yeast Medium (YM) broth. Other defined or synthetic growth media may also be used, and the appropriate medium for growth of the particular microorganism will be known by one skilled in the art of microbiology or fermentation science. The use of agents known to modulate catabolite repression directly or indirectly, e.g., cyclic adenosine 2',3'-monophosphate (cAMP), may also be incorporated into the fermentation medium.

Suitable pH ranges for the fermentation are between pH 5.0 to pH 9.0, where pH 6.0 to pH 8.0 is preferred for the initial condition.

Fermentations may be performed under aerobic or anaerobic conditions, where anaerobic or microaerobic conditions are preferred.

Industrial Batch and Continuous Fermentations

The present process employs a batch method of fermentation. A classical batch fermentation is a closed system where the composition of the medium is set at the beginning of the fermentation and not subject to artificial alterations during the fermentation. Thus, at the beginning of the fermentation the medium is inoculated with the desired microorganism or microorganisms, and fermentation is permitted to occur without adding anything to the system. Typically, however, a "batch" fermentation is batch with respect to the addition of carbon source and attempts are often made at controlling factors such as pH and oxygen concentration. In batch systems the metabolite and biomass compositions of the system change constantly up to the time the fermentation is stopped. Within batch cultures cells moderate through a static lag phase to a high growth log phase and finally to a stationary phase where growth rate is diminished or halted. If untreated, cells in the stationary phase will eventually die. Cells in log phase generally are responsible for the bulk of production of end product or intermediate.

A variation on the standard batch system is the Fed-Batch system. Fed-Batch fermentation processes are also suitable in the present invention and comprise a typical batch system with the exception that the substrate is added in increments as the fermentation progresses. Fed-Batch systems are useful when catabolite repression is apt to inhibit the metabolism of the cells and where it is desirable to have limited amounts of substrate in the medium. Measurement of the actual substrate concentration in Fed-Batch systems is difficult and is therefore estimated on the basis of the changes of measurable factors such as pH, dissolved oxygen and the partial pressure of waste gases such as $CO_2$. Batch and Fed-Batch fermentations are common and well known in the art and examples may be found in Thomas D. Brock in *Biotechnology: A Textbook of Industrial Microbiology*, Second Edition (1989) Sinauer Associates, Inc., Sunderland, Mass., or Deshpande, Mukund (Appl. Biochem. Biotechnol., 36: 227, 1992), herein incorporated by reference.

Although the present invention is performed in batch mode it is contemplated that the method would be adaptable to continuous fermentation methods. Continuous fermentation is an open system where a defined fermentation medium is added continuously to a bioreactor and an equal amount of conditioned medium is removed simultaneously for processing. Continuous fermentation generally maintains the cultures at a constant high density where cells are primarily in log phase growth.

Continuous fermentation allows for modulation of one factor or any number of factors that affect cell growth or end product concentration. For example, one method will maintain a limiting nutrient such as the carbon source or nitrogen level at a fixed rate and allow all other parameters to moderate. In other systems a number of factors affecting growth may be altered continuously while the cell concentration, measured by medium turbidity, is kept constant. Continuous systems strive to maintain steady state growth conditions and thus the cell loss due to the medium being drawn off must be balanced against the cell growth rate in the fermentation. Methods of modulating nutrients and growth factors for continuous fermentation processes as well as techniques for maximizing the rate of product formation are well known in the art of industrial microbiology and a variety of methods are detailed by Brock, supra.

It is contemplated that the present invention may be practiced using either batch, fed-batch or continuous processes and that any known mode of fermentation would be suitable. Additionally, it is contemplated that cells may be immobilized on a substrate as whole cell catalysts and subjected to fermentation conditions for isobutanol production.

Methods for Isobutanol Isolation from the Fermentation Medium

Bioproduced isobutanol may be isolated from the fermentation medium using methods known in the art for ABE fermentations (see, e.g., Durre, *Appl. Microbiol. Biotechnol.* 49:639-648 (1998), Groot et al., *Process. Biochem.* 27:61-75 (1992), and references therein). For example, solids may be removed from the fermentation medium by centrifugation, filtration, decantation, or the like. Then, the isobutanol may be isolated from the fermentation medium using methods such as distillation, azeotropic distillation, liquid-liquid extraction, adsorption, gas stripping, membrane evaporation, or pervaporation.

Because isobutanol forms a low boiling point, azeotropic mixture with water, distillation can be used to separate the mixture up to its azeotropic composition. Distillation may be used in combination with another separation method to obtain separation around the azeotrope. Methods that may be used in combination with distillation to isolate and purify butanol include, but are not limited to, decantation, liquid-liquid extraction, adsorption, and membrane-based techniques. Additionally, butanol may be isolated using azeotropic distillation using an entrainer (see, e.g., Doherty and Malone, *Conceptual Design of Distillation Systems*, McGraw Hill, New York, 2001).

The butanol-water mixture forms a heterogeneous azeotrope so that distillation may be used in combination with decantation to isolate and purify the isobutanol. In this method, the isobutanol containing fermentation broth is distilled to near the azeotropic composition. Then, the azeotropic mixture is condensed, and the isobutanol is separated from the fermentation medium by decantation. The decanted aqueous phase may be returned to the first distillation column as reflux. The isobutanol-rich decanted organic phase may be further purified by distillation in a second distillation column.

The isobutanol can also be isolated from the fermentation medium using liquid-liquid extraction in combination with distillation. In this method, the isobutanol is extracted from the fermentation broth using liquid-liquid extraction with a suitable solvent. The isobutanol-containing organic phase is then distilled to separate the butanol from the solvent.

Distillation in combination with adsorption can also be used to isolate isobutanol from the fermentation medium. In this method, the fermentation broth containing the isobutanol is distilled to near the azeotropic composition and then the remaining water is removed by use of an adsorbent, such as molecular sieves (Aden et al., *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation may be used to isolate and purify the isobutanol from the fermentation medium. In this method, the fermentation broth containing the isobutanol is distilled to near the azeotropic composition, and then the remaining water is removed by pervaporation through a hydrophilic membrane (Guo et al., *J. Membr. Sci.* 245, 199-210 (2004)).

In situ product removal (ISPR) (also referred to as extractive fermentation) can be used to remove butanol (or other fermentative alcohol) from the fermentation vessel as it is produced, thereby allowing the microorganism to produce butanol at high yields. One method for ISPR for removing fermentative alcohol that has been described in the art is liquid-liquid extraction. In general, with regard to butanol fermentation, for example, the fermentation medium, which includes the microorganism, is contacted with an organic extractant at a time before the butanol concentration reaches a toxic level. The organic extractant and the fermentation medium form a biphasic mixture. The butanol partitions into the organic extractant phase, decreasing the concentration in the aqueous phase containing the microorganism, thereby limiting the exposure of the microorganism to the inhibitory butanol.

Liquid-liquid extraction can be performed, for example, according to the processes described in U.S. Patent Appl. Pub. No. 2009/0305370, the disclosure of which is hereby incorporated in its entirety. U.S. Patent Appl. Pub. No. 2009/0305370 describes methods for producing and recovering butanol from a fermentation broth using liquid-liquid extraction, the methods comprising the step of contacting the fermentation broth with a water immiscible extractant to form a two-phase mixture comprising an aqueous phase and an organic phase. Typically, the extractant can be an organic extractant selected from the group consisting of saturated, mono-unsaturated, poly-unsaturated (and mixtures thereof) $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, and mixtures thereof. The extractant(s) for ISPR can be non-alcohol extractants. The ISPR extractant can be an exogenous organic extractant such as oleyl alcohol, behenyl alcohol, cetyl alcohol, lauryl alcohol, myristyl alcohol, stearyl alcohol, 1-undecanol, oleic acid, lauric acid, myristic acid, stearic acid, methyl myristate, methyl oleate, undecanal, lauric aldehyde, 20-methylundecanal, and mixtures thereof.

In some embodiments, the alcohol can be formed by contacting the alcohol in a fermentation medium with an organic acid (e.g., fatty acids) and a catalyst capable of esterfiying the alcohol with the organic acid. In such embodiments, the organic acid can serve as an ISPR extractant into which the alcohol esters partition. The organic acid can be supplied to the fermentation vessel and/or derived from the biomass supplying fermentable carbon fed to the fermentation vessel. Lipids present in the feedstock can be catalytically hydrolyzed to organic acid, and the same catalyst (e.g., enzymes) can esterify the organic acid with the alcohol. The catalyst can be supplied to the feedstock prior to fermentation, or can be supplied to the fermentation vessel before or contemporaneously with the supplying of the feedstock. When the catalyst is supplied to the fermentation vessel, alcohol esters can be obtained by hydrolysis of the lipids into organic acid and substantially simultaneous esterification of the organic acid with butanol present in the fermentation vessel. Organic acid and/or native oil not derived from the feedstock can also be fed to the fermentation vessel, with the native oil being hydrolyzed into organic acid. Any organic acid not esterified with the alcohol can serve as part of the ISPR extractant. The extractant containing alcohol esters can be separated from the fermentation medium, and the alcohol can be recovered from the extractant. The extractant can be recycled to the fermentation vessel. Thus, in the case of butanol production, for example, the conversion of the butanol to an ester reduces the free butanol concentration in the fermentation medium, shielding the microorganism from the toxic effect of increasing butanol concentration. In addition, unfractionated grain can be used as feedstock without separation of lipids therein, since the lipids can be catalytically hydrolyzed to organic acid, thereby decreasing the rate of build-up of lipids in the ISPR extractant.

In situ product removal can be carried out in a batch mode or a continuous mode. In a continuous mode of in situ product removal, product is continually removed from the reactor. In a batchwise mode of in situ product removal, a volume of organic extractant is added to the fermentation vessel and the extractant is not removed during the process. For in situ product removal, the organic extractant can contact the fermentation medium at the start of the fermentation forming a biphasic fermentation medium. Alternatively, the organic extractant can contact the fermentation medium after the microorganism has achieved a desired amount of growth, which can be determined by measuring the optical density of the culture. Further, the organic extractant can contact the fermentation medium at a time at which the product alcohol level in the fermentation medium reaches a preselected level. In the case of butanol production according to some embodiments of the present invention, the organic acid extractant can contact the fermentation medium at a time before the butanol concentration reaches a toxic level, so as to esterify the butanol with the organic acid to produce butanol esters and consequently reduce the concentration of butanol in the fermentation vessel. The ester-containing organic phase can then be removed from the fermentation vessel (and separated from the fermentation broth which constitutes the aqueous phase) after a desired effective titer of the butanol esters is achieved. In some embodiments, the ester-containing organic phase is separated from the aqueous phase after fermentation of the available fermentable sugar in the fermentation vessel is substantially complete.

Isobutanol Production

As described and demonstrated herein, Applicants have discovered KARI enzyme variants suited for use in isobutanol production pathways.

In embodiments, isobutanol production employing such a variant may provide reduced glycerol accumulation. In embodiments, the molar ratio of isobutanol to glycerol is increased for a variant of a polypeptide having KARI activity described above with $K_M$ for NADH lower than that of the unsubstituted polypeptide. In embodiments, the molar ratio of isobutanol to glycerol is greater than 1. In embodiments, the molar ratio of isobutanol to glycerol is greater than 2. In embodiments, the molar ratio is greater than 3. In embodiments, the molar ratio is greater than 4, greater than 5, greater than 6, greater than 7, greater than 8, greater than 9, greater than 10, greater than 12, or greater than 14. In embodiments, the molar ratio is in the range of about 1 to 5, about 1 to 10, about 2 to 8, about 5 to 10, about 5 to 15 about 10 to 15 or about 12 to 15.

Examples

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

General Methods:

Materials and methods suitable for the maintenance and growth of bacterial cultures are also well known in the art. Techniques suitable for use in the following Examples may be found in *Manual of Methods for General Bacteriology*, Phillipp Gerhardt, R. G. E. Murray, Ralph N. Costilow, Eugene W. Nester, Willis A. Wood, Noel R. Krieg and G. Briggs Phillips, eds., American Society for Microbiology, Washington, D.C., 1994, or by Thomas D. Brock in *Biotechnology: A Textbook of Industrial Microbiology*, Second Edition, Sinauer Associates, Inc., Sunderland, Mass., 1989. All reagents, restriction enzymes and materials used for the growth and maintenance of bacterial cells were obtained from Aldrich Chemicals (Milwaukee, Wis.), BD Diagnostic Systems (Sparks, Md.), Life Technologies (Rockville, Md.), or Sigma Chemical Company (St. Louis, Mo.), unless otherwise specified.

The meaning of abbreviations used is as follows: "A" means Angstrom, "min" means minute(s), "h" means hour(s), "μl" means microliter(s), "ng/μl" means nano gram per microliter, "pmol/μl" means pico mole per microliter, "ml" means milliliter(s), "L" means liter(s), "g/L" mean gram per liter, "ng" means nano gram, "sec" means second(s), "ml/min" means milliliter per minute(s), "w/v" means weight per volume, "v/v" means volume per volume, "nm" means nanometer(s), "mm" means millimeter(s), "cm" means centimeter(s), "mM" means millimolar, "M" means molar, "g" means gram(s), "μg" means microgram(s), "mg" means milligram(s), "g" means the gravitation constant, "rpm" means revolutions per minute, "HPLC" means high performance liquid chromatography, "MS" means mass spectrometry, "HPLC/MS" means high performance liquid chromatography/mass spectrometry, "EDTA" means ethylendiamine-tetraacetic acid, "dNTP" means deoxynucleotide triphosphate, "° C." means degrees Celsius, and "V" means voltage.

The numbering of the positions of substitutions given in the Examples is based on the full-length *Anaerostipes caccae* KARI sequence (SEQ ID NO: 93).

Construction of Strains PNY2068 and PNY2115 Used in the Examples

*Saccharomyces cerevisiae* strain PNY0827 is used as the host cell for further genetic manipulation for PNY2068 and PNY2115. PNY0827 refers to a strain derived from *Saccharomyces cerevisiae* which has been deposited at the ATCC under the Budapest Treaty on Sep. 22, 2011 at the American Type Culture Collection, Patent Depository 10801 University Boulevard, Manassas, Va. 20110-2209 and has the patent deposit designation PTA-12105.

Deletion of URA3 and Sporulation into Haploids

In order to delete the endogenous URA3 coding region, a deletion cassette was PCR-amplified from pLA54 (SEQ ID NO: 1) which contains a P$_{TEF1}$-kanMX4-TEF1t cassette flanked by loxP sites to allow homologous recombination in vivo and subsequent removal of the KANMX4 marker. PCR was done by using Phusion High Fidelity PCR Master Mix (New England BioLabs; Ipswich, Mass.) and primers BK505 (SEQ ID NO: 2) and BK506 (SEQ ID NO: 3). The URA3 portion of each primer was derived from the 5' region 180 bp upstream of the URA3 ATG and 3' region 78 bp downstream of the coding region such that integration of the kanMX4 cassette results in replacement of the URA3 coding region. The PCR product was transformed into PNY0827 using standard genetic techniques (Methods in Yeast Genetics, 2005, Cold Spring Harbor Laboratory Press, Cold Spring Harbor, N.Y., pp. 201-202) and transformants were selected on YEP medium supplemented 2% glucose and 100 μg/ml Geneticin at 30° C. Transformants were screened by colony PCR with primers LA468 (SEQ ID NO: 4) and LA492 (SEQ ID NO: 5) to verify the integration cassette. A heterozygous diploid was obtained: NYLA98, which has the genotype MATa/α URA3/ura3::loxP-kanMX4-loxP. To obtain haploids, NYLA98 was sporulated using standard methods (Codón A C, Gasent-Ramírez J M, Benitez T. Factors which affect the frequency of sporulation and tetrad formation in *Saccharomyces cerevisiae* baker's yeast. Appl Environ Microbiol. 1995 PMID: 7574601). Tetrads were dissected using a micromanipulator and grown on rich YPE medium supplemented with 2% glucose. Tetrads containing four viable spores were patched onto synthetic complete medium lacking uracil supplemented with 2% glucose, and the mating type was verified by multiplex colony PCR using primers AK109-1 (SEQ ID NO: 6), AK109-2 (SEQ ID NO: 7), and AK109-3 (SEQ ID NO: 8). The resulting indentified haploid strain called NYLA103, which has the genotype: MATα ura3Δ::loxP-kanMX4-loxP, and NYLA106, which has the genotype: MATa ura3Δ::loxP-kanMX4-loxP.

Deletion of His3

To delete the endogenous HIS3 coding region, a scarless deletion cassette was used. The four fragments for the PCR cassette for the scarless HIS3 deletion were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). HIS3 Fragment A was amplified with primer oBP452 (SEQ ID NO: 9) and primer oBP453 (SEQ ID NO: 10), containing a 5' tail with homology to the 5' end of HIS3 Fragment B. HIS3 Fragment B was amplified with primer oBP454 (SEQ ID NO: 11), containing a 5' tail with homology to the 3' end of HIS3 Fragment A, and primer oBP455 (SEQ ID NO: 12) containing a 5' tail with homology to the 5' end of HIS3 Fragment U. HIS3 Fragment U was amplified with primer oBP456 (SEQ ID NO: 13), containing a 5' tail with homology to the 3' end of HIS3 Fragment B, and primer oBP457 (SEQ ID NO: 14), containing a 5' tail with homology to the 5' end of HIS3 Fragment C. HIS3 Fragment C was amplified with primer oBP458 (SEQ ID NO: 15), containing a 5' tail with homology to the 3' end of HIS3 Fragment U, and primer oBP459 (SEQ ID NO: 16). PCR products were purified with a PCR Purification kit (Qiagen). HIS3 Fragment AB was created by overlapping PCR by mixing HIS3 Fragment A and HIS3 Fragment B and amplifying with primers oBP452 (SEQ ID NO: 9) and oBP455 (SEQ ID NO: 12). HIS3 Fragment UC was created by overlapping PCR by mixing HIS3 Fragment U and HIS3 Fragment C and amplifying with primers oBP456 (SEQ ID NO: 13) and oBP459 (SEQ ID NO: 16). The resulting PCR products were purified on an agarose gel followed by a Gel Extraction kit (Qiagen). The HIS3 ABUC cassette was created by overlapping PCR by mixing HIS3 Fragment AB and HIS3 Fragment UC and amplifying with primers oBP452 (SEQ ID NO: 9) and oBP459 (SEQ ID NO: 16). The PCR product was purified with a PCR Purification kit (Qiagen). Competent cells of NYLA106 were transformed with the HIS3 ABUC PCR cassette and were plated on synthetic complete medium lacking uracil supplemented with 2% glucose at 30° C. Transformants were screened to verify correct integration by replica plating onto synthetic complete medium lacking histidine and supplemented with 2% glucose at 30° C. Genomic DNA preps were made to verify the integration by PCR using primers oBP460 (SEQ ID NO: 17) and LA135 (SEQ ID NO: 18) for the 5' end and primers oBP461 (SEQ ID NO: 19) and LA92 (SEQ ID NO: 20) for the 3' end. The URA3 marker was recycled by plating on synthetic complete medium supplemented with 2% glucose and 5-FOA at 30° C. following standard protocols. Marker removal was confirmed by patching colonies from the 5-FOA plates onto SD-URA medium to verify the absence of growth. The resulting identified strain, called PNY2003 has the genotype: MATa ura3Δ::loxP-kanMX4-loxP his3Δ.

Deletion of PDC1

To delete the endogenous PDC1 coding region, a deletion cassette was PCR-amplified from pLA59 (SEQ ID NO: 21), which contains a URA3 marker flanked by degenerate loxP sites to allow homologous recombination in vivo and subsequent removal of the URA3 marker. PCR was done by using Phusion High Fidelity PCR Master Mix (New England BioLabs; Ipswich, Mass.) and primers LA678 (SEQ ID NO: 22) and LA679 (SEQ ID NO: 23). The PDC1 portion of each primer was derived from the 5' region 50 bp downstream of the PDC1 start codon and 3' region 50 bp upstream of the stop codon such that integration of the URA3 cassette results in replacement of the PDC1 coding region but leaves the first 50 bp and the last 50 bp of the coding region. The PCR product was transformed into PNY2003 using standard genetic techniques and transformants were selected on synthetic complete medium lacking uracil and supplemented with 2% glucose at 30° C. Transformants were screened to verify correct integration by colony PCR using primers LA337 (SEQ ID NO: 24), external to the 5' coding region and LA135 (SEQ ID NO: 18), an internal primer to URA3. Positive transformants were then screened by colony PCR using primers LA692 (SEQ ID NO: 25) and LA693 (SEQ ID NO: 26), internal to the PDC1 coding region. The URA3 marker was recycled by transforming with pLA34 (SEQ ID NO: 27) containing the CRE recombinase under the GAL1 promoter and plated on synthetic complete medium lacking histidine and supplemented with 2% glucose at 30° C. Transformants were plated on rich medium supplemented with 0.5% galactose to induce the recombinase. Marker removal was confirmed by patching colonies to synthetic complete medium lacking uracil and supplemented with 2% glucose to verify absence of growth. The resulting identified strain, called PNY2008 has the genotype: MATa ura3Δ::loxP-kanMX4-loxP his3Δ pdc1Δ::loxP71/66.

Deletion of PDC5

To delete the endogenous PDC5 coding region, a deletion cassette was PCR-amplified from pLA59 (SEQ ID NO: 21), which contains a URA3 marker flanked by degenerate loxP sites to allow homologous recombination in vivo and subsequent removal of the URA3 marker. PCR was done by using Phusion High Fidelity PCR Master Mix (New England BioLabs; Ipswich, Mass.) and primers LA722 (SEQ ID NO: 28) and LA733 (SEQ ID NO: 29). The PDC5 portion of each primer was derived from the 5' region 50 bp upstream of the PDC5 start codon and 3' region 50 bp downstream of the stop codon such that integration of the URA3 cassette results in replacement of the entire PDC5 coding region. The PCR product was transformed into PNY2008 using standard genetic techniques and transformants were selected on synthetic complete medium lacking uracil and supplemented with 1% ethanol at 30° C. Transformants were screened to verify correct integration by colony PCR using primers LA453 (SEQ ID NO: 30), external to the 5' coding region and LA135 (SEQ ID NO: 18), an internal primer to URA3. Positive transformants were then screened by colony PCR using primers LA694 (SEQ ID NO: 31) and LA695 (SEQ ID NO: 32), internal to the PDC5 coding region. The URA3 marker was recycled by transforming with pLA34 (SEQ ID NO: 27) containing the CRE recombinase under the GAL1 promoter and plated on synthetic complete medium lacking histidine and supplemented with 1% ethanol at 30° C. Transformants were plated on rich YEP medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, called PNY2009 has the genotype: MATa ura3Δ::loxP-kanMX4-loxP his3Δ pdc1Δ::loxP71/66 pdc5Δ::loxP71/66.

Deletion of FRA2

The FRA2 deletion was designed to delete 250 nucleotides from the 3' end of the coding sequence, leaving the first 113 nucleotides of the FRA2 coding sequence intact. An in-frame stop codon was present 7 nucleotides downstream of the deletion. The four fragments for the PCR cassette for the scarless FRA2 deletion were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). FRA2 Fragment A was amplified with primer oBP594 (SEQ ID NO: 33) and primer oBP595 (SEQ ID NO: 34), containing a 5' tail with homology to the 5' end of FRA2 Fragment B. FRA2 Fragment B was amplified with primer oBP596 (SEQ ID NO: 35), containing a 5" tail with homology to the 3' end of FRA2 Fragment A, and primer oBP597 (SEQ ID NO: 36), containing a 5' tail with homology to the 5' end of FRA2 Fragment U. FRA2 Fragment U was amplified with primer oBP598 (SEQ ID NO: 37), containing a 5' tail with homology to the 3' end of FRA2 Fragment B, and primer oBP599 (SEQ ID NO: 38), containing a 5' tail with homology to the 5' end of FRA2 Fragment C. FRA2 Fragment C was amplified with primer oBP600 (SEQ ID NO: 39), containing a 5' tail with homology to the 3' end of FRA2 Fragment U, and primer oBP601 (SEQ ID NO: 40). PCR products were purified with a PCR Purification kit (Qiagen). FRA2 Fragment AB was created by overlapping PCR by mixing FRA2 Fragment A and FRA2 Fragment B and amplifying with primers oBP594 (SEQ ID NO: 33) and oBP597 (SEQ ID NO: 36). FRA2 Fragment UC was created by overlapping PCR by mixing FRA2 Fragment U and FRA2 Fragment C and amplifying with primers oBP598 (SEQ ID NO: 37) and oBP601 (SEQ ID NO: 40). The resulting PCR products were purified on an agarose gel followed by a Gel Extraction kit (Qiagen). The FRA2 ABUC cassette was created by overlapping PCR by mixing FRA2 Fragment AB and FRA2 Fragment UC and amplifying with primers oBP594 (SEQ ID NO: 33) and oBP601 (SEQ ID NO: 40). The PCR product was purified with a PCR Purification kit (Qiagen).

To delete the endogenous FRA2 coding region, the scarless deletion cassette obtained above was transformed into PNY2009 using standard techniques and plated on synthetic complete medium lacking uracil and supplemented with 1% ethanol. Genomic DNA preps were made to verify the integration by PCR using primers oBP602 (SEQ ID NO: 41) and LA135 (SEQ ID NO: 18) for the 5' end, and primers oBP602 (SEQ ID NO: 41) and oBP603 (SEQ ID NO: 42) to amplify the whole locus. The URA3 marker was recycled by plating on synthetic complete medium supplemented with 1% ethanol and 5-FOA (5-Fluoroorotic Acid) at 30° C. following standard protocols. Marker removal was confirmed by patching colonies from the 5-FOA plates onto synthetic complete medium lacking uracil and supplemented with 1% ethanol to verify the absence of growth. The resulting identified strain, PNY2037, has the genotype: MATa ura3Δ::loxP-kanMX4-loxP his3Δ pdc1Δ::loxP71/66 pdc5Δ::loxP71/66 fra2Δ.

Addition of Native 2 Micron Plasmid

The loxP71-URA3-loxP66 marker was PCR-amplified using Phusion DNA polymerase (New England BioLabs; Ipswich, Mass.) from pLA59 (SEQ ID NO: 29), and transformed along with the LA811×817 (SEQ ID NOs: 43, 44) and LA812×818 (SEQ ID NOs: 45, 46) 2-micron plasmid fragments (amplified from the native 2-micron plasmid from CEN.PK 113-7D; Centraalbureau voor Schimmelcultures (CBS) Fungal Biodiversity Centre) into strain PNY2037 on SE-URA plates at 30° C. The resulting strain PNY2037 2μ::loxP71-URA3-loxP66 was transformed with pLA34 (pRS423::cre) (also called, pLA34) (SEQ ID NO: 27) and selected on SE-HIS-URA plates at 30° C. Transformants were patched onto YP-1% galactose plates and allowed to grow for 48 hrs at 30° C. to induce Cre recombinase expression. Individual colonies were then patched onto SE-URA, SE-HIS, and YPE plates to confirm URA3 marker removal. The resulting identified strain, PNY2050, has the genotype: MATa ura3Δ::loxP-kanMX4-loxP, his3Δpdc1Δ::loxP71/66 pdc5Δ::loxP71/66 fra2Δ 2-micron.

Construction of PNY2068 from PNY2050

PNY2068 [MATa ura3Δ::loxP-kanMX4-loxP his3Δ pdc1Δ::loxP71/66 pdc5Δ::loxP71/66 fra2Δ 2-micron gpd2Δ ymr226cΔ::$P_{FBA1}$-alsS_Bs-CYC1t-loxP71/66 ald6Δ::(UAS)PGK1-$P_{FBA1}$-kivD_Lg-TDH3t-loxP71/66 adh1Δ::$P_{ILV5}$-ADH_Bi(y)-ADH1t-loxP71/66 pdc1Δ::$P_{PDC1}$-ADH_Bi(y)-ADH1t-loxP71/66] was constructed as follows from PNY2050.

Deletion of GPD2

To delete the endogenous GPD2 coding region, a deletion cassette was PCR-amplified from pLA59 (SEQ ID NO: 21), which contains a URA3 marker flanked by degenerate loxP sites to allow homologous recombination in vivo and subsequent removal of the URA3 marker. PCR was done by using Phusion High Fidelity PCR Master Mix (New England BioLabs; Ipswich, Mass.) and primers LA512 (SEQ ID NO: 47) and LA513 (SEQ ID NO: 48). The GPD2 portion of each primer was derived from the 5' region 50 bp upstream of the GPD2 start codon and 3' region 50 bp downstream of the stop codon such that integration of the URA3 cassette results in replacement of the entire GPD2 coding region. The PCR product was transformed into PNY2050 using standard genetic techniques and transformants were selected on synthetic complete medium lacking uracil and supplemented with 1% ethanol at 30° C. Transformants were screened to verify correct integration by colony PCR using primers LA516 (SEQ ID NO: 49), external to the 5' coding region and LA135 (SEQ ID NO: 18), internal to URA3. Positive transformants were then screened by colony PCR using primers LA514 (SEQ ID NO: 50) and LA515 (SEQ ID NO: 51), internal to the GPD2 coding region. The URA3 marker was recycled by transforming with pLA34 (SEQ ID NO: 27) containing the CRE recombinase under the GAL1 promoter and plated on synthetic complete medium lacking histidine and supplemented with 1% ethanol at 30° C. Transformants were plated on rich medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, PNY2056, has the genotype: MATa ura3Δ::loxP-kanMX4-loxP his3Δ pdc1Δ::loxP71/66 pdc5Δ::loxP71/66 fra2Δ 2-micron gpd2Δ.

Deletion of YMR226 and Integration of AlsS

To delete the endogenous YMR226C coding region, an integration cassette was PCR-amplified from pLA71 (SEQ ID NO: 52), which contains the gene acetolactate synthase from the species Bacillus subtilis with a FBA1 promoter and a CYC1 terminator, and a URA3 marker flanked by degenerate loxP sites to allow homologous recombination in vivo and subsequent removal of the URA3 marker. PCR was done by using KAPA HiFi from Kapa Biosystems, Woburn, Mass. and primers LA829 (SEQ ID NO: 53) and LA834 (SEQ ID NO: 54). The YMR226C portion of each primer was derived from the first 60 bp of the coding sequence and 65 bp that are 409 bp upstream of the stop codon. The PCR product was transformed into PNY2056 using standard genetic techniques and transformants were selected on synthetic complete medium lacking uracil and supplemented with 1% ethanol at 30° C. Transformants were screened to verify correct integration by colony PCR using primers N1257 (SEQ ID NO: 55), external to the 5' coding region and LA740 (SEQ ID NO: 61), internal to the FBA1 promoter. Positive transformants were then screened by colony PCR using primers N1257 (SEQ ID NO: 55) and LA830 (SEQ ID NO: 56), internal to the YMR226C coding region, and primers LA830 (SEQ ID NO: 56), external to the 3' coding region, and LA92 (SEQ ID NO: 20), internal to the URA3 marker. The URA3 marker was recycled by transforming with pLA34 (SEQ ID NO: 27) containing the CRE recombinase under the GAL1 promoter and plated on synthetic complete medium lacking histidine and supplemented with 1% ethanol at 30° C. Transformants were plated on rich medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, PNY2061, has the genotype: MATa ura3Δ::loxP-kanMX4-loxP his3Δ pdc1Δ::loxP71/66 pdc5Δ::loxP71/66 fra2Δ 2-micron gpd2Δ ymr226cΔ::$P_{FBA1}$-alsS_Bs-CYC1t-loxP71/66.

Deletion of ALD6 and Integration of KivD

To delete the endogenous ALD6 coding region, an integration cassette was PCR-amplified from pLA78 (SEQ ID NO: 57), which contains the kivD gene from the species Listeria grayi with a hybrid FBA1 promoter and a TDH3 terminator, and a URA3 marker flanked by degenerate loxP sites to allow homologous recombination in vivo and subsequent removal of the URA3 marker. PCR was done by using KAPA HiFi from Kapa Biosystems, Woburn, Mass. and primers LA850 (SEQ ID NO: 58) and LA851 (SEQ ID NO: 59). The ALD6 portion of each primer was derived from the first 65 bp of the coding sequence and the last 63 bp of the coding region. The PCR product was transformed into PNY2061 using standard genetic techniques and transformants were selected on synthetic complete medium lacking uracil and supplemented with 1% ethanol at 30° C. Transformants were screened to verify correct integration by colony PCR using primers N1262 (SEQ ID NO: 60), external to the 5' coding region and LA740 (SEQ ID NO: 61), internal to the FBA1 promoter. Positive transformants were then screened by colony PCR using primers N1263 (SEQ ID NO: 62), external to the 3' coding region, and LA92 (SEQ ID NO: 20), internal to the URA3 marker. The URA3 marker was recycled by transforming with pLA34 (SEQ ID NO: 27) containing the CRE recombinase under the GAL1 promoter and plated on synthetic complete medium lacking histidine and supplemented with 1% ethanol at 30° C. Transformants were plated on rich medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, PNY2065, has the genotype: MATa ura3Δ::loxP-kanMX4-loxP his3Δ pdc1Δ::loxP71/66 pdc5Δ::loxP71/66 fra2Δ 2-micron gpd2Δ ymr226cΔ::P$_{FBA1}$-alsS_Bs-CYC1t-loxP71/66 ald6Δ::(UAS)PGK1-P$_{FBA1}$-kivD_Lg-TDH3t-loxP71.

Deletion of ADH1 and Integration of ADH

ADH1 is the endogenous alcohol dehydrogenase present in *Saccharomyces cerevisiae*. As described below, the endogenous ADH1 was replaced with alcohol dehydrogenase (ADH) from *Beijerinckii indica*. To delete the endogenous ADH1 coding region, an integration cassette was PCR-amplified from pLA65 (SEQ ID NO: 63), which contains the alcohol dehydrogenase from the species *Beijerinckii indica* with an ILV5 promoter and a ADH1 terminator, and a URA3 marker flanked by degenerate loxP sites to allow homologous recombination in vivo and subsequent removal of the URA3 marker. PCR was done by using KAPA HiFi from Kapa Biosystems, Woburn, Mass. and primers LA855 (SEQ ID NO: 64) and LA856 (SEQ ID NO: 65). The ADH1 portion of each primer was derived from the 5' region 50 bp upstream of the ADH1 start codon and the last 50 bp of the coding region. The PCR product was transformed into PNY2065 using standard genetic techniques and transformants were selected on synthetic complete medium lacking uracil and supplemented with 1% ethanol at 30° C. Transformants were screened to verify correct integration by colony PCR using primers LA414 (SEQ ID NO: 66), external to the 5' coding region and LA749 (SEQ ID NO: 67), internal to the ILV5 promoter. Positive transformants were then screened by colony PCR using primers LA413 (SEQ ID NO: 68), external to the 3' coding region, and LA92 (SEQ ID NO: 20), internal to the URA3 marker. The URA3 marker was recycled by transforming with pLA34 (SEQ ID NO: 27) containing the CRE recombinase under the GAL1 promoter and plated on synthetic complete medium lacking histidine and supplemented with 1% ethanol at 30° C. Transformants were plated on rich medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, called PNY2066 has the genotype: MATa ura3Δ::loxP-kanMX4-loxP his3Δ pdc1Δ::loxP71/66 pdc5Δ::loxP71/66 fra2Δ 2-micron gpd2Δ ymr226cΔ::P$_{FBA1}$-alsS_Bs-CYC1t-loxP71/66 ald6Δ::(UAS)PGK1-P$_{FBA1}$-kivD_Lg-TDH3t-loxP71/66 adh1Δ::P$_{ILV5}$-ADH_Bi(y)-ADH1t-loxP71/66.

Integration of ADH into pdc1Δ Locus

To integrate an additional copy of ADH at the pdc1Δ region, an integration cassette was PCR-amplified from pLA65 (SEQ ID NO: 63), which contains the alcohol dehydrogenase from the species *Beijerinckii indica* with an ADH1 terminator, and a URA3 marker flanked by degenerate loxP sites to allow homologous recombination in vivo and subsequent removal of the URA3 marker. PCR was done by using KAPA HiFi from Kapa Biosystems, Woburn, Mass. and primers LA860 (SEQ ID NO: 69) and LA679 (SEQ ID NO: 23). The PDC1 portion of each primer was derived from the 5' region 60 bp upstream of the PDC1 start codon and 50 bp that are 103 bp upstream of the stop codon. The endogenous PDC1 promoter was used. The PCR product was transformed into PNY2066 using standard genetic techniques and transformants were selected on synthetic complete medium lacking uracil and supplemented with 1% ethanol at 30° C. Transformants were screened to verify correct integration by colony PCR using primers LA337 (SEQ ID NO: 24), external to the 5' coding region and N1093 (SEQ ID NO: 70), internal to the BiADH gene. Positive transformants were then screened by colony PCR using primers LA681 (SEQ ID NO: 71), external to the 3' coding region, and LA92 (SEQ ID NO: 20), internal to the URA3 marker. The URA3 marker was recycled by transforming with pLA34 (SEQ ID NO: 27) containing the CRE recombinase under the GAL1 promoter and plated on synthetic complete medium lacking histidine and supplemented with 1% ethanol at 30° C. Transformants were plated on rich medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain was called PNY2068 and has the genotype: MATa ura3Δ::loxP-kanMX4-loxP his3Δ pdc1Δ::loxP71/66 pdc5Δ::loxP71/66 fra2Δ 2-micron gpd2Δ ymr226cΔ::P$_{FBA1}$alsS_Bs-CYC1t-loxP71/66 ald6Δ::(UAS)PGK1-P$_{FBA1}$-kivD_Lg-TDH3t-loxP71/66 adh1Δ::P$_{ILV5}$-ADH_Bi(y)-ADH1t-loxP71/66 pdc1Δ::P$_{PDC1}$-ADH_Bi(y)-ADH1t-loxP71/66.

Construction of PNY2115 from PNY2050

Construction of PNY2115 [MATa ura3Δ::loxP his3Δ pdc5Δ::loxP66/71 fra2Δ 2-micron plasmid (CEN.PK2) pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66 fra2Δ::P[ILV5]-ADH|Bi(y)-ADHt-loxP71/66 gpd2Δ::loxP71/66] from PNY2050 was as follows.

pdc1Δ::P[PDC1]-ALS|alsS Bs-CYC1t-loxP71/66

To integrate alsS into the pdc1Δ::loxP66/71 locus of PNY2050 using the endogenous PDC1 promoter, An integration cassette was PCR-amplified from pLA71 (SEQ ID NO: 52), which contains the gene acetolactate synthase from the species *Bacillus subtilis* with a FBA1 promoter and a CYC1 terminator, and a URA3 marker flanked by degenerate loxP sites to allow homologous recombination in vivo and subsequent removal of the URA3 marker. PCR was done by using KAPA HiFi and primers 895 (SEQ ID NO: 72) and 679 (SEQ ID NO: 73). The PDC1 portion of each primer was derived from 60 bp of the upstream of the coding sequence and 50 bp that are 53 bp upstream of the stop codon. The PCR product was transformed into PNY2050 using standard genetic techniques and transformants were selected on synthetic complete media lacking uracil and supplemented with 1% ethanol at 30° C. Transformants were screened to verify correct integration by colony PCR using primers 681 (SEQ ID NO: 74), external to the 3' coding region and 92 (SEQ ID NO: 75), internal to the URA3 gene. Positive transformants were then prepped for genomic DNA and screened by PCR using primers N245 (SEQ ID NO: 76) and N246 (SEQ ID NO: 77). The URA3 marker was recycled by transforming with pLA34 (SEQ ID NO: 27) containing the CRE recombinase under the GAL1 promoter and plated on synthetic complete media lacking histidine and supplemented with 1% ethanol at 30° C. Transformants were plated on rich media supplemented with 1% ethanol and 0.5% galactose to induce the recombinase. Marker removal was confirmed by patching colonies to synthetic complete media lacking uracil and supplemented with 1% ethanol to verify absence of growth. The resulting identified strain, called PNY2090 has the genotype MATa ura3Δ::loxP, his3Δ, pdc1Δ::loxP71/66, pdc5Δ::loxP71/66 fra2Δ 2-micron pdc1Δ::P[PDC1]-ALS|alsS_Bs-CYC1t-loxP71/66.

pdc6Δ::(UAS)PGK1-P[FBA1]-KIVD|Lg(y)-TDH3t-loxP71/66

To delete the endogenous PDC6 coding region, an integration cassette was PCR-amplified from pLA78 (SEQ ID NO: 57), which contains the kivD gene from the species *Listeria grayi* with a hybrid FBA1 promoter and a TDH3 terminator, and a URA3 marker flanked by degenerate loxP sites to allow homologous recombination in vivo and subsequent removal of the URA3 marker. PCR was done by using KAPA HiFi and primers 896 (SEQ ID NO: 78) and 897 (SEQ ID NO: 79). The PDC6 portion of each primer was derived from 60 bp upstream of the coding sequence and 59 bp downstream of the coding region. The PCR product was transformed into PNY2090 using standard genetic techniques and transformants were selected on synthetic complete media lacking uracil and supplemented with 1% ethanol at 30° C. Transformants were screened to verify correct integration by colony PCR using primers 365 (SEQ ID NO: 80) and 366 (SEQ ID NO: 81), internal primers to the PDC6 gene. Transformants with an absence of product were then screened by colony PCR N638 (SEQ ID NO: 82), external to the 5' end of the gene, and 740 (SEQ ID NO: 83), internal to the FBA1 promoter. Positive transformants were than the prepped for genomic DNA and screened by PCR with two external primers to the PDC6 coding sequence. Positive integrants would yield a 4720 bp product, while PDC6 wild type transformants would yield a 2130 bp product. The URA3 marker was recycled by transforming with pLA34 containing the CRE recombinase under the GAL1 promoter and plated on synthetic complete media lacking histidine and supplemented with 1% ethanol at 30° C. Transformants were plated on rich media supplemented with 1% ethanol and 0.5% galactose to induce the recombinase. Marker removal was confirmed by patching colonies to synthetic complete media lacking uracil and supplemented with 1% ethanol to verify absence of growth. The resulting identified strain is called PNY2093 and has the genotype MATa ura3Δ::loxP his3Δ pdc5Δ::loxP71/66 fra2Δ 2-micron pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66.

adh1Δ::P[ADH1]-ADH|Bi(y)-ADHt-loxP71/66

To delete the endogenous ADH1 coding region and integrate BiADH using the endogenous ADH1 promoter, an integration cassette was PCR-amplified from pLA65 (SEQ ID NO: 63), which contains the alcohol dehydrogenase from the species *Beijerinckii* with an ILV5 promoter and a ADH1 terminator, and a URA3 marker flanked by degenerate loxP sites to allow homologous recombination in vivo and subsequent removal of the URA3 marker. PCR was done by using KAPA HiFi and primers 856 (SEQ ID NO: 84) and 857 (SEQ ID NO: 85). The ADH1 portion of each primer was derived from the 5' region 50 bp upstream of the ADH1 start codon and the last 50 bp of the coding region. The PCR product was transformed into PNY2093 using standard genetic techniques and transformants were selected on synthetic complete media lacking uracil and supplemented with 1% ethanol at 30° C. Transformants were screened to verify correct integration by colony PCR using primers BK415 (SEQ ID NO: 86), external to the 5' coding region and N1092 (SEQ ID NO: 87), internal to the BiADH gene. Positive transformants were then screened by colony PCR using primers 413 (SEQ ID NO: 88), external to the 3' coding region, and 92 (SEQ ID NO: 75), internal to the URA3 marker. The URA3 marker was recycled by transforming with pLA34 (SEQ ID NO: 27) containing the CRE recombinase under the GAL1 promoter and plated on synthetic complete media lacking histidine and supplemented with 1% ethanol at 30° C. Transformants were plated on rich media supplemented with 1% ethanol and 0.5% galactose to induce the recombinase. Marker removal was confirmed by patching colonies to synthetic complete media lacking uracil and supplemented with 1% ethanol to verify absence of growth. The resulting identified strain, called PNY2101 has the genotype MATa ura3Δ::loxP his3Δ pdc5Δ::loxP71/66 fra2Δ 2-micron pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66.

fra2Δ::P[ILV5]-ADH|Bi(y)-ADHt-loxP71/66

To integrate BiADH into the fra2Δ locus of PNY2101, an integration cassette was PCR-amplified from pLA65 (SEQ ID NO: 63), which contains the alcohol dehydrogenase from the species *Beijerinckii indica* with an ILV5 promoter and an ADH1 terminator, and a URA3 marker flanked by degenerate loxP sites to allow homologous recombination in vivo and subsequent removal of the URA3 marker. PCR was done by using KAPA HiFi and primers 906 (SEQ ID NO: 89) and 907 (SEQ ID NO: 90). The FRA2 portion of each primer was derived from the first 60 bp of the coding sequence starting at the ATG and 56 bp downstream of the stop codon. The PCR product was transformed into PNY2101 using standard genetic techniques and transformants were selected on synthetic complete media lacking uracil and supplemented with 1% ethanol at 30° C. Transformants were screened to verify correct integration by colony PCR using primers 667 (SEQ ID NO: 91), external to the 5' coding region and 749 (SEQ ID NO: 92), internal to the ILV5 promoter. The URA3 marker was recycled by transforming with pLA34 (SEQ ID NO: 27) containing the CRE recombinase under the GAL1 promoter and plated on synthetic complete media lacking histidine and supplemented with 1% ethanol at 30° C. Transformants were plated on rich media supplemented with 1% ethanol and 0.5% galactose to induce the recombinase. Marker removal was confirmed by patching colonies to synthetic complete media lacking uracil and supplemented with 1% ethanol to verify absence of growth. The resulting identified strain, called PNY2110 has the genotype MATa ura3Δ::loxP his3Δ pdc5Δ::loxP66/71 2-micron pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1l::P[ADH1]-ADH|Bi(y)-ADHt-loxP71/66 fra2Δ::P[ILV5]-ADH|Bi(y)-ADHt-loxP71/66.

GPD2 Deletion

To delete the endogenous GPD2 coding region, a deletion cassette was PCR amplified from pLA59 (SEQ ID NO: 21), which contains a URA3 marker flanked by degenerate loxP sites to allow homologous recombination in vivo and subsequent removal of the URA3 marker. PCR was done by using KAPA HiFi and primers LA512 (SEQ ID NO: 47) and LA513 (SEQ ID NO: 48). The GPD2 portion of each primer was derived from the 5' region 50 bp upstream of the GPD2 start codon and 3' region 50 bp downstream of the stop codon such that integration of the URA3 cassette results in replacement of the entire GPD2 coding region. The PCR product was transformed into PNY2110 using standard genetic techniques and transformants were selected on synthetic complete medium lacking uracil and supplemented with 1% ethanol at 30° C. Transformants were screened to verify correct integration by colony PCR using primers LA516 (SEQ ID NO: 49) external to the 5' coding region and LA135 (SEQ ID NO: 18), internal to URA3. Positive transformants were then screened by colony PCR using primers LA514 (SEQ ID NO: 50) and LA515 (SEQ ID NO: 51), internal to the GPD2 coding region. The URA3 marker was recycled by transforming with pLA34 (SEQ ID NO: 27) containing the CRE recombinase under the GAL1 promoter and plated on synthetic complete medium lacking histidine and supplemented with 1% ethanol at 30° C. Transformants were plated on rich medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, called PNY2115, has the genotype MATa ura3Δ::loxP his3Δ pdc5Δ::loxP66/71 fra2Δ 2-micron pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66 fra2Δ::P[ILV5]-ADH|Bi(y)-ADHt-loxP71/66 gpd2Δ::loxP71/66.

Example 1

Combinatorial Mutagenesis of K9SB2_SH at Positions 90 and 93 to Generate K9YW Library Positions 90 and 93 (numbering is based on the full length KARI enzyme from *Anaerostipes caccae*; SEQ ID NO: 93) were selected for combinatorial mutagenesis of *Anaerostipes caccae* KARI variant K9SB2_SH (SEQ ID NO: 94). Substitutions at these positions were observed previously in screens of an K9SB2 ePCR library. A set of variants containing each possible combination of Lys, Ala, Met, Leu, or Tyr at position 90 with Thr, Leu, Ile, Val, or Ala at position 93 was generated. The 25 variants were prepared via sequential mutagenesis at positions 90 and 93 with K9SB2_SH_DHAD (SEQ ID NO: 95) as the initial template. Both mutagenesis procedures were initiated via a PCR step with a mix of mutagenic primers followed by a second reaction employing the PCR product as a megaprimer.

The PCR reaction for mutagenesis at position 90 was performed with PFUultra polymerase (Catalog #600380; Agilent Technologies, Stratagene Products Division, La Jolla, Calif.). The primers in the mix (Table 1; Position 90) and primer SB2_r1 (TGG ACC GGT AAT GTA GTC ACC; SEQ ID NO: 96) were commercially synthesized by Integrated DNA Technologies, Inc (Coralville Iowa). The PCR reaction consisted of 1 µl of K9SB2_SH-DHAD (SEQ ID NO: 95) (50 ng/µl), 4 µl of 90mix (10 uM), 4 ul SB2_r1 (10 uM), 10 ul of 10×PFUultra buffer, 1 µl of 10 mM dNTP mix, 1 µl of PFUultra DNA polymerase, and 34 µl of ddH₂O. The following conditions were used for the PCR reaction: The starting temperature was 95° C. for 2.0 min followed by 35 heating/cooling cycles. Each cycle consisted of 95° C. for 30 sec, 55° C. for 30 sec, and 68° C. for 30 sec. At the completion of the temperature cycling, the sample was kept at 68° C. for 10.0 min more, and then held awaiting sample recovery at 4° C. The reaction product was separated from the template via agarose gel electrophoresis (1% agarose, 1×TBE buffer) and recovered using the illustra GFX PCR DNA and Gel Band Purification kit (Cat#28-9034-70, GE Healthcare Life Sciences, Piscataway, N.J.) as recommended by the manufacturer.

TABLE 1

Primers for Combinatorial Mutagenesis

Forward Primer Set for Position 90

SB2_K90 (native): Cccagatgaaaagcaggctaccatgtacaa
 aaacg
 (SEQ ID NO: 97)
SB2_K90M_f: Cccagatgaaatgcaggctaccatgtacaa
 aaacg
 (SEQ ID NO: 98)
SB2_K90L_f: Cccagatgaattgcaggctaccatgtacaa
 aaacg
 (SEQ ID NO: 99)
SB2_K90Y_f: Cccagatgaataccaggctaccatgtacaa
 aaacg
 (SEQ ID NO: 100)
SB2_K90A _f: Cccagatgaagctcaggctaccatgtacaa
 aaacg
 (SEQ ID NO: 101)

Forward Primer Set for Position 93

SB2_T93 (native): caggctaccatgtacaaaaacgacatcgaacc
 (SEQ ID NO: 102)
SB2_T93I_f: caggctatcatgtacaaaaacgacatcgaacc
 (SEQ ID NO: 103)
SB2_T93A _f: caggctgctatgtacaaaaacgacatcgaacc
 (SEQ ID NO: 104)
SB2_T93L_f: caggctttgatgtacaaaaacgacatcgaacc
 (SEQ ID NO: 105)
SB2_T93V_f: caggctgttatgtacaaaaacgacatcgaacc
 (SEQ ID NO: 106)

The isolated reaction product was employed as a megaprimer to generate the set of position 90 variants employing the QuikChange® Lightning Site-Directed Mutagenesis Kit (Catalog #200523; Agilent Technologies, Stratagene Products Division, La Jolla, Calif.). Except for the primers, templates, and ddH₂O, all reagents used here were supplied with the kit. The reaction mixture contained 1 µl K9SB2_SH_DHAD (50 ng/µl), 4 µl of K90 megaprimer, 5 µl of 10× reaction buffer, 1 µl of dNTP mix, 1.5 ul QuikSolution, 1 ul QuikChange Lightning Enzyme, and 37.5 µl of ddH₂O. The following conditions were used for the reactions: The starting temperature was 95° C. for 2 min followed by 18 heating/cooling cycles. Each cycle consisted of 95° C. for 20 sec, 60° C. for 10 sec, and 68° C. for 14 min. At the completion of the temperature cycling, the samples incubated at 68° C. for 7 min and then held awaiting sample recovery at 4° C. 2 µl of the Dpn I (10 U/µl) was added to each reaction and the mixtures were incubated for 5 min at 37° C.

4 µl of each mutagenic reaction was transformed into One Shot® Top10 Chemically Competent *E. coli* (Invitrogen, Catalog # C404003) on agar plates containing the LB medium and 100 µg/ml ampicillin (Cat#L1004, Teknova Inc. Hollister, Calif.) and incubated at 37° C. overnight. Multiple transformants were then selected for TempliPhi™ (GE Healthcare) based DNA sequencing employing primers pHR81-F (ACACCCAGTATTTTCCCTTTCC; SEQ ID NO: 107) and pHR81-Rev (CTA GTG TAC AGA TGT ATG TCG G; SEQ ID NO: 108). Transformants with confirmed KARI sequences were inoculated into LB medium containing 100 µg/ml ampicillin and incubated at 37° C. with shaking at 225 rpm. Plasmid DNA was isolated from the cells with the QIAprep Spin Miniprep Kit (Catalog #2706; Qiagen, Valencia, Calif.) according to the protocol provided by the manufacturer. Clones were combined into a K90 plasmid mix.

The PCR reaction for mutagenesis at position 93 was performed as described above with modifications. The primers in 93 mix (Table 1) were commercially synthesized by Integrated DNA Technologies, Inc (Coralville Iowa). The PCR reaction consisted of 1 μl of K9SB2_SH-DHAD (SEQ ID NO: 95) (50 ng/μl), 4 μl of 93mix (10 uM), 4 ul SB2_r1, 10 ul of 10×PFU ultra reaction buffer, 1 μl of 10 mM dNTP mix, 1 μl of PFUultra DNA polymerase, and 34 μl of ddH$_2$O. The subsequent reaction employing the QuikChange® Lightning Site-Directed Mutagenesis Kit was performed as described above with modifications. The reaction mixture contained 1 μl K90 plasmid mix (50 ng/μl), 4 μl of K90 megaprimer, 5 μl of 10× reaction buffer, 1 μl of dNTP mix, 1.5 ul QuikSolution, 1 ul QuikChange Lightning Enzyme, and 37.5 μl of ddH$_2$O.

Following the two mutagenesis steps and templiphi-based DNA sequencing, plasmids for 25 variants were isolated and DNA sequences reconfirmed. The amino acid substitutions for variants are provided in Table 2.

TABLE 2

KARI variants in K9YW Library

| Variant | Position 90 | Position 93 | Amino Acid SEQ ID NO: |
|---|---|---|---|
| K9YW1 (K9SB2_SH) | K | T | 94 |
| K9YW2 | K | I | 109 |
| K9YW3 | K | A | 110 |
| K9YW4 | K | V | 111 |
| K9YW5 | K | L | 112 |
| K9YW6 | M | T | 113 |
| K9YW7 | M | I | 114 |
| K9YW8 | M | A | 115 |
| K9YW9 | M | V | 116 |
| K9YW10 | M | L | 117 |
| K9YW11 | L | T | 118 |
| K9YW12 | L | I | 119 |
| K9YW13 | L | A | 120 |
| K9YW14 | L | V | 121 |
| K9YW15 | L | L | 122 |
| K9YW16 (K9YWJM) | Y | T | 123 |
| K9YW17 | Y | I | 124 |
| K9YW18 | Y | A | 125 |
| K9YW19 | Y | V | 126 |
| K9YW20 | Y | L | 127 |
| K9YW21 | A | T | 128 |
| K9YW22 | A | I | 129 |
| K9YW23 | A | A | 130 |
| K9YW24 | A | V | 131 |
| K9YW25 | A | L | 132 |

Example 2

Yeast Isobutanol Production for K9YW Variants

The resultant 25 plasmids from combinatorial mutagenesis at positions 90 and 93 were employed to evaluate isobutanol production in yeast grown under anaerobic conditions in a 48-well plate. Isobutanol production strains were made in host PNY2259 (MATa ura3Δ::loxP his3Δ pdc6Δ pdc1Δ::P[PDC1]-DHAD|ilvD_Sm-PDC1t-P[FBA1]-AL-S|alsS_Bs-CYC1t pdc5Δ::P[PDC5]-ADH|sadB_Ax-PDC5t gpd2Δ::loxP fra2Δ::P[PDC1]-ADH|adh_HI-ADH1t adh1Δ:: UAS(PGK1)P[FBA1]-kivD_Lg(y)-ADH 1t yprcΔ15Δ::P [PDC5]-ADH|adh_HI-ADH1t ymr226cΔ ald6Δ::loxP) by transforming the plasmids containing the coding sequences for the KARI variants and plating on synthetic medium without uracil (1% ethanol as carbon source). Yeast colonies from the transformation on SE-Ura plates appeared after 3-5 days of incubation at 30° C. At least three colonies from each variant were patched onto fresh SE-Ura plates and incubated at 30° C.

Yeast Cultivation Conditions:

Aerobic cultivation medium: SE-Ura medium with 2 g/l ethanol.

Anaerobic cultivation medium: SEG-Ura with 30 g/l glucose and 1 g/l ethanol, supplemented with 10 mg/l ergosterol, 50 mM MES buffer (pH 5.5), 30 mg/l thiamine, and 30 mg/l nicotinic acid.

48-well plates: Axygen catalog # P-5ML-48-C-S, 5 ml/well total volume, culture volume of 1.5 ml/well.

Plates were covered with a permeable adhesive film (VWR; catalog number 60941-086) for aerobic cultivation. Plates were shaken at 225 rpm at 30° C. For anaerobic cultivation, freshly inoculated plates covered with permeable film were purged of oxygen by equilibration in an anaerobic chamber for 2 hours. The plate covers were then exchanged for adhesive aluminum covers (VWR; catalog number 89049-034) and each plate was placed into an airtight plastic box (Mitsubishi Gas Chemical America, Inc; New York, N.Y.; Catalog 50-25) along with a fresh oxygen scavenger pack (Mitsubishi Gas Chemical America, Inc; New York, N.Y.; Catalog 10-01). The entire assembly (plate(s) and oxygen scavenger pack inside a sealed airtight plastic box) was removed from the anaerobic chamber and shaken at 225 rpm at 30° C.

Experimental Protocol

Single yeast colonies on SE-Ura agar plates were streaked onto fresh SE-Ura agar plates and incubated at 30° C. until dense patches of cells had grown. Liquid precultures in 48-well plates were inoculated with loops of these cells for initial aerobic cultivation. After shaking overnight, the OD600 of each culture well was measured by transferring 0.15 ml of each well into a flat-bottom 96-well plate and measuring the absorbance of each well at 600 nm with a Molecular Devices (Sunnyvale, Calif.) plate reader. A linear transformation based on an experimentally-determined calibration line was applied to these plate reader-measured optical densities to convert them into comparable absorbance values for a cuvette-based spectrophotometer.

A calculated portion of each aerobic preculture well was inoculated into the corresponding well of a fresh 48-well plate with 1.5 ml of the SEG-Ura medium, to achieve an initial OD600 (in cuvette spectrophotometer absorbance units) of 0.2. In the process of inoculating the fresh plate, the aerobic preculture plate was centrifuged, the supernatant was removed from each well, and the cells in each well were resuspended in fresh SEG-Ura medium. This anaerobic cultivation plate was shaken for 2 days. The isobutanol concentration in the culture supernatants was measured by HPLC (Table 3).

TABLE 3

Isobutanol Titer

| Variant | Position 90 | Position 93 | Mean Isobutanol Titer (mM) | Standard Deviation of Isobutanol Titer (mM) |
|---|---|---|---|---|
| K9SB2_SH | K | T | 15 | 5 |
| K9YW2 | K | I | 17 | 1 |
| K9YW3 | K | A | 1 | 1 |
| K9YW4 | K | V | 14 | 2 |
| K9YW5 | K | L | 15 | 3 |
| K9YW6 | M | T | 1 | 1 |
| K9YW7 | M | I | 11 | 2 |
| K9YW8 | M | A | 1 | 0 |
| K9YW9 | M | V | 17 | 2 |
| K9YW10 | M | L | 16 | 4 |
| K9YW11 | L | T | 10 | 3 |
| K9YW12 | L | I | 5 | 1 |
| K9YW13 | L | A | 8 | 13 |
| K9YW14 | L | V | 0 | 0 |
| K9YW15 | L | L | 4 | 6 |
| K9YWJM | Y | T | 17 | 2 |

TABLE 3-continued

Isobutanol Titer

| Variant | Position 90 | Position 93 | Mean Isobutanol Titer (mM) | Standard Deviation of Isobutanol Titer (mM) |
|---|---|---|---|---|
| K9YW17 | Y | I | 6 | 5 |
| K9YW18 | Y | A | 0 | 0 |
| K9YW19 | Y | V | 1 | 0 |
| K9YW20 | Y | L | 13 | 2 |
| K9YW21 | A | T | 11 | 4 |
| K9YW22 | A | I | 8 | 11 |
| K9YW23 | A | A | 15 | 3 |
| K9YW24 | A | V | 13 | 3 |
| K9YW25 | A | L | 19 | 6 |

Example 3

Combinatorial Mutagenesis of K9SB2_SH at Positions 90, 93, and 94 to Generate K9JM Library Additional derivatives of K9SB2_SH were prepared based on combinatorial mutagenesis at positions 90, 93, and 93 (numbering based on full length *Anaerostipes caccae* KARI). Generated variants contained Lys, Met, or Tyr at position 90, Ala, Ile, Thr, or Val at position 93, and Ile, Leu, Met, or Phe at position 94. Mutagenesis was performed via an initial PCR step with mixes of mutagenic primers followed by a set of reactions employing the PCR products as megaprimers. Mutagenic primers listed in Table 4 were commercially synthesized by Integrated DNA Technologies, Inc (Coralville Iowa).

TABLE 4

Primers for mutagenesis

| Primer # | Sequence | SEQ ID NO: |
|---|---|---|
| 1 | ccagatgaaAAGcaggctACCTTGtacaaaaacgacatcg | 133 |
| 2 | ccagatgaaAAGcaggctATCATGtacaaaaacgacatcg | 134 |
| 3 | ccagatgaaAAGcaggctATCATCtacaaaaacgacatcg | 135 |
| 4 | ccagatgaaAAGcaggctATCTTGtacaaaaacgacatcg | 136 |
| 5 | ccagatgaaAAGcaggctGCCATCtacaaaaacgacatcg | 137 |
| 6 | ccagatgaaAAGcaggctGCCTTGtacaaaaacgacatcg | 138 |
| 7 | ccagatgaaAAGcaggctGTCATGtacaaaaacgacatcg | 139 |
| 8 | ccagatgaaATGcaggctACCATCtacaaaaacgacatcg | 140 |
| 9 | ccagatgaaATGcaggctACCTTGtacaaaaacgacatcg | 141 |
| 10 | ccagatgaaATGcaggctATCATGtacaaaaacgacatcg | 142 |
| 11 | ccagatgaaTACcaggctACCATGtacaaaaacgacatcg | 143 |
| 12 | ccagatgaaATGcaggctGCCATGtacaaaaacgacatcg | 144 |
| 13 | ccagatgaaAAGcaggctACCTTCtacaaaaacgacatcg | 145 |

TABLE 4-continued

Primers for mutagenesis

| Primer # | Sequence | SEQ ID NO: |
|---|---|---|
| 14 | ccagatgaaAAGcaggctGTCATCtacaaaaacgacatcg | 146 |
| 15 | ccagatgaaAAGcaggctGTCTTGtacaaaaacgacatcg | 147 |
| 16 | ccagatgaaATGcaggctATCATCtacaaaaacgacatcg | 148 |
| 17 | ccagatgaaATGcaggctATCTTGtacaaaaacgacatcg | 149 |
| 18 | ccagatgaaTTGcaggctACCATCtacaaaaacgacatcg | 150 |
| 19 | ccagatgaaTTGcaggctACCTTGtacaaaaacgacatcg | 151 |
| 20 | ccagatgaaTTGcaggctATCATGtacaaaaacgacatcg | 152 |
| 21 | ccagatgaaTTGcaggctGCCATGtacaaaaacgacatcg | 153 |
| 22 | ccagatgaaTACcaggctGCCATGtacaaaaacgacatcg | 154 |
| 23 | ccagatgaaTACcaggctACCATCtacaaaaacgacatcg | 155 |
| 24 | ccagatgaaTACcaggctACCTTGtacaaaaacgacatcg | 156 |
| 25 | ccagatgaaTACcaggctATCATGtacaaaaacgacatcg | 157 |
| 26 | ccagatgaaATGcaggctGCCATCtacaaaaacgacatcg | 158 |
| 27 | ccagatgaaATGcaggctGCCTTGtacaaaaacgacatcg | 159 |
| 28 | ccagatgaaATGcaggctGTCATGtacaaaaacgacatcg | 160 |
| 29 | ccagatgaaAAGcaggctATCTTCtacaaaaacgacatcg | 161 |
| 30 | ccagatgaaAAGcaggctGCCTTCtacaaaaacgacatcg | 162 |
| 31 | ccagatgaaATGcaggctACCTTCtacaaaaacgacatcg | 163 |
| 32 | ccagatgaaTTGcaggctATCATCtacaaaaacgacatcg | 164 |
| 33 | ccagatgaaTTGcaggctATCTTGtacaaaaacgacatcg | 165 |
| 34 | ccagatgaaTTGcaggctGCCATCtacaaaaacgacatcg | 166 |
| 35 | ccagatgaaTTGcaggctGCCTTGtacaaaaacgacatcg | 167 |
| 36 | ccagatgaaTACcaggctGCCATCtacaaaaacgacatcg | 168 |
| 37 | ccagatgaaTACcaggctGCCTTGtacaaaaacgacatcg | 169 |
| 38 | ccagatgaaTTGcaggctGTCATGtacaaaaacgacatcg | 170 |
| 39 | ccagatgaaTACcaggctATCATCtacaaaaacgacatcg | 171 |
| 40 | ccagatgaaTACcaggctATCTTGtacaaaaacgacatcg | 172 |
| 41 | ccagatgaaTACcaggctGTCATGtacaaaaacgacatcg | 173 |
| 42 | ccagatgaaATGcaggctGTCATCtacaaaaacgacatcg | 174 |
| 43 | ccagatgaaATGcaggctGTCTTGtacaaaaacgacatcg | 175 |
| 44 | ccagatgaaATGcaggctATCTTCtacaaaaacgacatcg | 176 |
| 45 | ccagatgaaATGcaggctGCCTTCtacaaaaacgacatcg | 177 |
| 46 | ccagatgaaAAGcaggctGTCTTCtacaaaaacgacatcg | 178 |
| 47 | ccagatgaaTTGcaggctACCTTCtacaaaaacgacatcg | 179 |
| 48 | ccagatgaaTACcaggctACCTTCtacaaaaacgacatcg | 180 |
| 49 | ccagatgaaTTGcaggctGTCATCtacaaaaacgacatcg | 181 |
| 50 | ccagatgaaTTGcaggctGTCTTGtacaaaaacgacatcg | 182 |
| 51 | ccagatgaaTACcaggctGTCATCtacaaaaacgacatcg | 183 |

TABLE 4-continued

Primers for mutagenesis

| Primer # | Sequence | SEQ ID NO: |
|---|---|---|
| 52 | ccagatgaaTACcaggctGTCTTGtacaaaaacgacatcg | 184 |
| 53 | ccagatgaaTTGcaggctATCTTCtacaaaaacgacatcg | 185 |
| 54 | ccagatgaaTTGcaggctGCCTTCtacaaaaacgacatcg | 186 |
| 55 | ccagatgaaTACcaggctGCCTTCtacaaaaacgacatcg | 187 |
| 56 | ccagatgaaTACcaggctATCTTCtacaaaaacgacatcg | 188 |
| 57 | ccagatgaaTTGcaggctGTCTTCtacaaaaacgacatcg | 189 |
| 58 | ccagatgaaTACcaggctGTCTTCtacaaaaacgacatcg | 190 |
| Reverse | gctgaaaacacaccttgtaatatccacttacatgactttgg | 191 |

PCR with Mutagenic Primers

Primers were combined into six groups. Group 1: primers 1-10; Group 2: primers 11-20; Group 3: primers 21-30; Group 4: primers 31-40; Group 5: primers 41-50; Group 6: primers 51-58. 10 µL aliquots of each primer were placed into a sterile 1.5 mL Eppendorf tubes. The primer mixture was then diluted 10-fold with molecular biology grade water, to a final overall concentration of 10 µM. The Reverse primer was diluted 10-fold to a final concentration of 10 µM.

The PCR was performed using Phusion DNA Polymerase (New England BioLabs; Ipswich, Mass.); all reagents with the exception of primers, DNA template and molecular biology grade water, were supplied with the polymerase. DNA template used was plasmid K9SB2_SH_DHAD (SEQ ID NO: 95). The PCR reactions were composed of 10 µL 5× Phusion HF Buffer, 2 µL 5 mM dNTPs, 2.5 µL of 10 µM forward primer mixture, 2.5 µL of 10 µM reverse primer, 2 µL 50 ng/µL template DNA, 0.5 µL Phusion DNA Polymerase and 30.5 µL molecular biology grade water. The following conditions were used for all reactions: The starting temperature was 98° C. for 30 sec followed by 30 heating/cooling cycles. Each cycle consisted of 98° C. for 10 sec, 58° C. for 15 sec, and 72° C. for 2.0 min. At the completion of the temperature cycling, a final 72° C. step run for 5.0 minutes and the samples were held at 4° C. until sample recovery could occur.

The desired PCR products were separated using gel electrophoresis. 5.5 µL 10× Loading Dye (Invitrogen, 10816-015) was added to each sample. 20 µL of each sample was loaded into the lanes of a 1% agarose gel and the gel was run at 140 V for 30 minutes in 1×TBE buffer to separate DNA sizes. Expected fragment size was approximately 3500 bp and bands of this size were excised from the gel and placed in pre-weighed sterile eppendorf tubes. The tubes were purified from the gel using the QIAquick Gel Extraction Kit (Catalog #28704, Qiagen, Valencia, Calif.) according to the manufacture's protocol, with the following modification. The filter unit was washed three times with 750 µL PE Buffer. The recovered PCR products were then used as the primers for the next step in the process.

Amplification of the Yeast Expression Plasmids with the Mega-Primers

The PCR step in which the plasmid was amplified and the mutations were introduced was performed by employing Agilent's Quikchange Lightning Site-Directed Mutagenesis kit (Catalog #210518; Agilent Technologies, Stratagene Products Division, La Jolla, Calif.). The reaction consisted of 250 ng purified mega-primer PCR product, 100 ng K9SB2_SH_DHAD template DNA (SEQ ID NO: 95), 5 µL 10× reaction buffer, 1.5 µL Quik Solution, 1 µL dNTP mix and a volume of molecular biology grade water to bring the entire reaction volume to 50 µL. Except for the primers, template, and ddH$_2$O, all reagents used here were supplied with the kit indicated above. The following conditions were used for both reactions: The starting temperature was 95° C. for 30 sec followed by 16 heating/cooling cycles. Each cycle consisted of 95° C. for 30 sec, 55° C. for 30 sec, and 68° C. for 6.0 min. At the completion of the temperature cycling, the samples held awaiting sample recovery at 4° C. 1 µl of the Dpn I (10 U/µl) was added to each reaction and the mixtures were incubated for 1 hour at 37° C.

2 µl of each mutagenic reaction was transformed into One Shot® TOP10 Chemically Competent E. coli (Invitrogen, Catalog #C404003) according to the manufacturer's instructions. The transformants were spread on agar plates containing the LB medium and 100 µg/ml ampicillin (Cat#L1004, Teknova Inc. Hollister, Calif.) and incubated at 37° C. overnight. Multiple transformants were then selected for TempliPhi™ (GE Healthcare) based DNA sequencing employing primers pHR81-F (ACACCCAGTATTTTC-CCTTTCC; SEQ ID NO: 107). and pHR81-Rev (CTA GTG TAO AGA TGT ATG TCG G; SEQ ID NO: 108). Transformants with confirmed KARI sequences were inoculated into LB medium containing 100 µg/ml ampicillin and incubated at 37° C. with shaking at 225 rpm. Plasmid DNA was isolated from the cells with the QIAprep Spin Miniprep Kit (Catalog #2706; Qiagen, Valencia, Calif.) according to the protocol provided by the manufacturer. KARIs JM1-JM31 were identified (Table 5) and isobutanol production was analyzed (Example 4).

TABLE 5

KARI variants

| Variant | Position 90 | Position 93 | Position 94 | Amino Acid SEQ ID NO: |
|---|---|---|---|---|
| K9JM1 | L | A | L | 192 |
| K9JM2 | L | T | L | 193 |
| K9JM3 | Y | T | M | 194 |
| K9JM4 | M | A | L | 195 |

TABLE 5-continued

KARI variants

| Variant | Position 90 | Position 93 | Position 94 | Amino Acid SEQ ID NO: |
|---|---|---|---|---|
| K9JM5 | M | A | I | 196 |
| K9JM6 | M | T | I | 197 |
| K9JM7 | K | V | I | 198 |
| K9JM8 | K | A | I | 199 |
| K9JM9 | Y | A | F | 200 |
| K9JM10 | Y | T | I | 201 |
| K9JM11 | Y | T | L | 202 |
| K9JM12 | M | I | L | 203 |
| K9JM13 | L | V | L | 204 |
| K9JM14 | K | I | M | 205 |
| K9JM15 | K | I | F | 206 |
| K9JM16 | K | I | L | 207 |
| K9JM17 | L | I | I | 208 |
| K9JM18 | M | A | M | 209 |
| K9JM19 | M | I | M | 210 |
| K9JM20 | M | T | L | 211 |
| K9JM21 | K | V | L | 212 |
| K9JM22 | K | V | F | 213 |
| K9JM23 | K | A | L | 214 |
| K9JM24 | K | T | L | 215 |
| K9JM25 | L | A | M | 216 |
| K9JM26 | L | V | M | 217 |
| K9JM27 | L | I | M | 218 |
| K9JM28 | M | I | I | 219 |
| K9JM29 | K | V | M | 220 |
| K9JM30 | K | I | I | 221 |
| K9JM31 | K | T | F | 222 |

A second iteration of mutagenesis was performed to generate additional variants.

Mega-Primer Generating PCR

A subset of the primers in Table 4 were combined into three groups. Group S-1: primers 31, 44, 45, 48, 55, 56 and 58; Group S-2: primers 22, 25, 28 and 41; Group S-3: primers 24, 37, 40, 43 and 52. 10 µL aliquots of each primer were placed into a sterile 1.5 mL Eppendorf tubes. The primer mixture was then diluted 10-fold with molecular biology grade water, to a final overall concentration of 10 µM. The reverse primer was diluted 10-fold to a final concentration of 10 µM.

The PCR was performed using Phusion DNA Polymerase (New England BioLabs; Ipswich, Mass.); all reagents with the exception of primers, DNA template and molecular biology grade water, were supplied with the polymerase. DNA templates for the groups S-1, S-2 and S-3 were JM31 (SEQ ID NO: 222), JM29 (SEQ ID NO: 220) and JM16 (SEQ ID NO: 207), respectively. The mega-primer PCR reaction was composed of 10 µL 5× Phusion HF Buffer, 1 µL 10 mM dNTPs, 2.5 µL of 10 µM forward primer mixture, 2.5 µL of 10 µM reverse primer, 2.5 µL 1 ng/µL template DNA, 0.5 µL Phusion DNA Polymerase and 1 µL 50 mM $MgCl_2$ and 32.5 µL molecular biology grade water. The following conditions were used for all reactions: The starting temperature was 98° C. for 30 sec followed by 30 heating/cooling cycles. Each cycle consisted of 98° C. for 10 sec, 60° C. for 15 sec, and 72° C. for 2 minute and 20 seconds. At the completion of the temperature cycling, a final 72° C. step run for 5.0 minutes and the samples were held at 4° C. until sample recovery could occur.

The desired PCR products were separated using gel electrophoresis. 5.5 µL 10× Loading Dye (Invitrogen, 10816-015) was added to each sample. 20 µL of each sample was loaded into the lanes of a 1% agarose gel and the gel was run at 140 V for 30 minutes in 1×TBE buffer to separate DNA sizes. Expected fragment size was approximately 3500 bp and bands of this size were excised from the gel and placed in pre-weighed sterile eppendorf tubes. The tubes were purified from the gel using the QIAquick Gel Extraction Kit (Catalog #28704, Qiagen, Valencia, Calif.) according to the manufacture's protocol, with the following modification. The filter unit was washed three times with 750 µL PE Buffer. The recovered PCR products were then used as the primers for the next step in the process.

Amplification of the Yeast Expression Plasmids with the Mega-Primers

The PCR step in which the plasmid was amplified and the mutations were introduced was performed by employing Agilent's Quikchange Lightning Site-Directed Mutagenesis kit (Catalog #210518; Agilent Technologies, Stratagene Products Division, La Jolla, Calif.). The reaction consisted of 250 ng purified mega-primer PCR product, 100 ng K9SB2_SH_DHAD template DNA (SEQ ID NO: 95), 5 µL 10× reaction buffer, 1.5 µL Quik Solution, 1 µL dNTP mix and a volume of molecular biology grade water to bring the entire reaction volume to 50 µL. Except for the primers, template, and $ddH_2O$, all reagents used here were supplied with the kit indicated above. The following conditions were used for both reactions: The starting temperature was 95° C. for 30 sec followed by 16 heating/cooling cycles. Each cycle consisted of 95° C. for 30 sec, 55° C. for 30 sec, and 68° C. for 6.0 min. At the completion of the temperature cycling, the samples held awaiting sample recovery at 4° C. 1 µl of the Dpn I (10 U/µl) was added to each reaction and the mixtures were incubated for 1 hour at 37° C.

2 µl of each mutagenic reaction was transformed into One Shot® TOP10 Chemically Competent E. coli (Invitrogen, Catalog #C404003) according to the manufacturer's instructions. The transformants were spread on agar plates containing the LB medium and 100 µg/ml ampicillin (Cat#L1004, Teknova Inc. Hollister, Calif.) and incubated at 37° C. overnight. Multiple transformants were then selected for TempliPhi™ (GE Healthcare) based DNA sequencing employing primers primers pHR81-F (ACACCCAGT-ATTTTCCCTTTCC; SEQ ID NO: 107). and pHR81-Rev (CTA GTG TAC AGA TGT ATG TCG G; SEQ ID NO: 108). Transformants with confirmed KARI sequences were inoculated into LB medium containing 100 µg/ml ampicillin and incubated at 37° C. with shaking at 225 rpm. Plasmid DNA was isolated from the cells with the QIAprep Spin Miniprep Kit (Catalog #2706; Qiagen, Valencia, Calif.) according to the protocol provided by the manufacturer. KARIs JM32-JM44 were identified (see table 6) and isobutanol production was analyzed (Example 5).

TABLE 6

KARI Variants

| Variant | Position 90 | Position 93 | Position 94 | Amino Acid SEQ ID NO: |
|---|---|---|---|---|
| JM32 | M | A | F | 223 |
| JM33 | M | V | L | 224 |
| JM34 | M | V | M | 225 |
| JM35 | Y | A | F | 226 |
| JM36 | Y | A | L | 227 |
| JM37 | Y | A | M | 228 |
| JM38 | Y | I | L | 229 |
| JM39 | Y | I | M | 230 |
| JM40 | Y | T | F | 231 |
| JM41 | Y | T | L | 240 |
| JM42 | Y | V | F | 232 |
| JM43 | Y | V | L | 233 |
| JM44 | Y | V | M | 234 |

Example 4

Isobutanol Production of JM Variants in PNY2259 Growth Media

Three types of media were used during the growth procedure of yeast strains: a SE-ura recovery plate, an aerobic pre-culture media and an anaerobic culture media. All chemicals were obtained from Sigma unless otherwise noted (St. Louis, Mo.)

Yeast transformation recovery plate (SE-ura): 50 mM MES (pH 5.5), 6.7 g/L yeast nitrogen base without amino acids (Difco, 291940, Sparks, Md.), 1.4 g/L yeast synthetic drop-out medium supplement without histidine, leucine, tryptophan and uracil, 0.2% ethanol, 0.01% w/v leucine, 0.01% w/v histidine, and 0.002% w/v tryptophan.

Aerobic pre-culture media (SE-Ura-His): 6.7 g/L yeast nitrogen base without amino acids (Difco, 291940, Sparks, Md.), 1.4 g/L yeast synthetic drop-out medium supplement without histidine, leucine, tryptophan and uracil, 0.2% ethanol, 0.2% glucose, 0.01% w/v leucine, 0.1% w/v histidine, and 0.002% w/v tryptophan.

Anaerobic culture media (SEG-Ura-His): 50 mM MES (pH 5.5, 6.7 g/L yeast nitrogen base without amino acids (Difco, 291940, Sparks, Md.), 1.4 g/L yeast synthetic drop-out medium supplement without histidine, leucine, tryptophan and uracil, 0.1% ethanol, 3% glucose, 0.01% leucine, 0.1% histidine, 0.002% tryptophan, 30 mg/L nicotinic acid, 30 mg/L thiamine and 10 mg/L ergosterol made up in 50/50 v/v Tween/ethanol solution.

Deep-Well Plate Growth Procedure 1.5 mL aliquots of the aerobic pre-culture media were dispensed into each well of an Axygen 48 deep-well plate (#P-5 mL-48-C-S, Axygen, Union City, Calif.) and inoculated with cells grown on a SE-Ura-His agar plate. A sterile air permeable cover (#60941-086, VWR, Radnor, Pa.) was used to seal the culture plate. The plate was placed in a 30° C. incubator and was grown for 24 hours with shaking, when a target $OD_{600}$ value of 1.5 to 2.0 was reached; as determined by a Spectra Max384 Plus plate reader (Molecular Devices, Sunnyvale, Calif.). $OD_{600}$ values were recorded. Cells were pelleted in the plate via centrifugation using Heraeus Multifuge X1R centrifuge (Thermo Scientific, Waltham, Mass.) and a M-20 plate rotor (#41102742, Thermo Scientific, Waltham, Mass.) and the resulting supernatants were discarded. The cell pellets were transferred to a Coy Anaerobic Bag (Grass Lake, Mich.) where pellets were resuspended in 0.1 mL anaerobic growth media (described above) that had been to equilibrate to anaerobic conditions for at least 24 hours. The pellet/media suspension was used to inoculate 1.5 mL aliquots of anaerobic culture media in an Axygen 48 deep-well plate (#P-5 mL-48-C-S, Axygen, Union City, Calif.) to an initial target $OD_{600}$ value of 0.2. The plate was then sealed with a sterile foil seal (60941-076, VWR, Radnor, Pa.) and placed into MGC 2.5 L anerobic jar with oxygen scavenging pack (#50-25, #10-01, MGC AnaeroPac System, Japan), which was then sealed. The anaerobic jar was removed from the Coy Anaerobic Bag and was placed into a 30° C. incubator and was grown with shaking for 69 hours. At the end of the first anaerobic passage, cells were centrifuged samples of the supernatant were saved for HPLC analysis. The pellets were used to inoculate the subsequent anaerobic passage as dictated by the experiment; subsequent passages were grown 24-72 hours. Three transformants were evaluated for each variant (results given in Table 7). Select variants were analyzed in a serum vial study (results given in Table 8).

Serum Vial Growth Procedure 10 mL aliquots of aerobic pre-culture media in 125 mL flask with filtered lids were inoculated with cells grown on a SE-Ura-His agar plate. The aerobic pre-culture was grown aerobically for approximately 24 hours at 30° C. with shaking, until a target $OD_{600}$ value of approximately 1.5 to 2 was achieved. $OD_{600}$ values were determined using Cary 300 spectrophotemeter (Agilent Technologies, Wilmington, Del.) and the values were recorded. Cultures were transferred to 50 mL tubes (#89039-666, VWR, Radnor, Pa.) and cells were pelleted via centrifugation and the supernatant was discarded. Cell pellets were transferred into a Coy Anaerobic Bag (Grass Lake, Mich.) where pellets were resuspended in 1.0 mL anaerobic growth media (SEG-Ura-His). The resuspended cell pellets were used to inoculate 30 mL SEG-Ura-His media in 50 mL serum bottles (Wheaton, 223748, Millville, N.J.) to a target initial $OD_{600}$ value of 0.2. All anaerobic media, serum vials, stoppers and crimps were allowed to degas in the anaerobic bag for at least 24 hours prior to inoculation. Serum bottles were stoppered, crimped and transferred out of the anaerobic bag and grown at 30° C. with shaking at 240 rpm. Anaerobic cultures were grown for 24 to 72 hours to a target $OD_{600}$ value of at least 1.2. Additional anaerobic growth steps used the cells from the previous anaerobic culture step as inoculant, with an aliquot of supernatant saved for HPLC analysis. Three transformants were evaluated for each variant (results given in Table 8).

HPLC Analysis

Samples were taken for HPLC analysis and to obtain $OD_{600}$ values at the end of the anaerobic growth period. HPLC analysis was performed using a Waters 2695 separations unit, 2996 photodiode array detector, and 2414 refractive index detector (Waters, Milford, Mass.) with a Shodex Sugar SH-G pre-column and Shodex Sugar SH1011 separations column (Shodex, JM Science, Grand Island, N.Y.). Compounds were separated by isocratic elution at 0.01 N sulfuric acid with a flow rate of 0.5 mL/min. Chromatograms were analyzed using the Waters Empower Pro software.

TABLE 7

Isobutanol Titers: K9JM Variants Deep-Well Plate Analysis

| SEQ ID NO: | Variant | Isobutanol Titer, mM | | | |
|---|---|---|---|---|---|
| | | Passage 1 | Passage 2 | Passage 3 | Passage 4 |
| 94 | K9SB2_SH | 5.77 ± 6.03 | 95.90 ± 8.47 | 78.47 ± 23.81 | 22.80 ± 5.68 |
| 192 | K9JM1 | 5.27 ± 5.57 | 80.63 ± 30.76 | 109.4 ± 8.76 | 29.83 ± 5.31 |
| 193 | K9JM2 | 2.03 ± 1.62 | 91.33 ± 19.55 | 113.97 ± 2.40 | 15.27 ± 15.01 |
| 194 | K9JM3 | 27.73 ± 2.30 | 99.73 ± 14.27 | 102.00 ± 15.76 | 20.30 ± 6.56 |
| 195 | K9JM4 | 12.93 ± 12.19 | 104.13 ± 7.40 | 82.93 ± 21.81 | 20.9 ± 6.22 |
| 196 | K9JM5 | 2.53 ± 0.45 | 49.87 ± 32.36 | 30.25 ± 42.78 | 9.8 ± 9.43 |
| 197 | K9JM6 | 2.93 ± 2.22 | 92.43 ± 13.83 | 95.47 ± 11.86 | 13.3 ± 2.97 |
| 198 | K9JM7 | 14.60 ± 20.80 | 102.30 ± 6.50 | 103.73 ± 1.27 | 27.43 ± 1.16 |
| 199 | K9JM8 | 2.47 ± 3.09 | 50.47 ± 57.01 | 84.87 ± 16.92 | 17.93 ± 3.03 |
| 200 | K9JM9 | 4.47 ± 2.29 | 48.80 ± 51.54 | 72.53 ± 24.84 | 27.60 ± 12.27 |
| 201 | K9JM10 | 2.20 ± 3.12 | 35.50 ± 61.49 | 84.90 ± 13.63 | 19.57 ± 4.75 |
| 202 | K9JM11 | 17.47 ± 9.49 | 106.73 ± 3.70 | 94.40 ± 16.76 | 37.83 ± 8.98 |
| 203 | K9JM12 | 5.80 ± 5.04 | 102.77 ± 13.48 | 91.35 ± 9.12 | 23.30 ± 7.65 |

TABLE 8

Isobutanol Titers: K9JM Select Variants Serum Vial Analysis

| Variant | Isobutanol, mM Passage 1 |
|---|---|
| K9SB2_SH | 15.03 ± 6.07 |
| K9_David_SH; SEQ ID NO: 236 | 8.43 ± 3.49 |
| K9JM3 | 24.07 ± 8.01 |
| K9JM4 | 30.27 ± 2.36 |
| K9JM7 | 34.13 ± 3.62 |
| K9JM9 | 22.70 ± 6.46 |
| K9JM11 | 31.93 ± 3.23 |
| K9JM12 | 23.23 ± 5.32 |

Example 5

Isobutanol Production of K9JM Variants and Derivatives in PNY2115

Variants prepared in Examples 3 and Example 11 were analyzed for isobutanol production in yeast strain PNY2115 (MATa ura3Δ::loxP his3Δ pdc5Δ::loxP66/71 fra2Δ 2-micron plasmid (CEN.PK2) pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66 fra2Δ::P[ILV5]-ADH|Bi(y)-ADHt-loxP71/66 gpd2Δ::loxP71/66).

Growth Media

Four types of media were used during the growth procedure of yeast strains: SE-ura agar plate, SAG-2-ura agar plate, an aerobic pre-culture media and an anaerobic culture media. All chemicals were obtained from Sigma unless otherwise noted (St. Louis, Mo.).

Yeast transformation recovery plate (SE-ura): 50 mM MES (pH 5.5), 6.7 g/L yeast nitrogen base without amino acids (Difco, 291940, Sparks, Md.), 1.4 g/L yeast synthetic drop-out medium supplement without histidine, leucine, tryptophan and uracil, 0.2% ethanol, 0.01% w/v leucine, 0.01% w/v histidine, and 0.002% w/v tryptophan.

Glucose adaptation plate (SAG-2-Ura): 50 mM MES (pH 5.5, 6.7 g/L yeast nitrogen base without amino acids (Difco, 291940, Sparks, Md.), 1.4 g/L yeast synthetic drop-out medium supplement without histidine, leucine, tryptophan and uracil, 3 mM sodium acetate (pH 7.0), 2% w/v glucose, 0.01% leucine, 0.01% histidine, 0.002% tryptophan.

Aerobic pre-culture media (SAG-0.2-Ura): 6.7 g/L yeast nitrogen base without amino acids (Difco, 291940, Sparks, Md.), 1.4 g/L yeast synthetic drop-out medium supplement without histidine, leucine, tryptophan and uracil, 3 mM sodium acetate (pH 7.0), 0.2% glucose, 0.01% w/v leucine, 0.01% w/v histidine, and 0.002% w/v tryptophan.

Anaerobic culture media (SAG-3-Ura): 50 mM MES (pH 5.5, 6.7 g/L yeast nitrogen base without amino acids (Difco, 291940, Sparks, Md.), 1.4 g/L yeast synthetic drop-out medium supplement without histidine, leucine, tryptophan and uracil, 3 mM sodium acetate (pH 7.0), 3% w/v glucose, 0.01% leucine, 0.01% histidine, 0.002% tryptophan, 30 mg/L nicotinic acid, 30 mg/L thiamine and 10 mg/L ergosterol made up in 50/50 v/v Tween/ethanol solution.

Transformation and Glucose Adaptation

Competent cells of the PNY2115 were made and transformed with 1 μL of purified plasmid (~0.4-0.8 μg total DNA) using a Frozen-EZ Yeast Transformation II kit (Zymo Research; Orange, Calif.). Transformation mixtures were plated on SE-ura plates and incubated at 30° C. for 4 days. Three colonies for each transformant were selected and patched onto SE-ura plates and incubated at 30° C. for 2 days. Six transformants were employed for K9SB2_SH, K9ALL3 (SEQ ID NO: 237), and K9JM11. The variants then underwent glucose adaptation by patching onto SAG-2-Ura plates and growing for 2 days at 30° C.

1.5 mL aliquots of the aerobic pre-culture media were dispensed into each well of a VWR 48 deep-well plate (#82004-674, VWR, Radnor, Pa.) and inoculated with cells grown on a SAG-2-Ura agar plate, as described above. A sterile air permeable cover (#60941-086, VWR, Radnor, Pa.) was used to seal the culture plate. The plate was placed in a 30° C. incubator and was grown for 24 hours with shaking, when a target $OD_{600}$ value of 1.5 to 2.0 was reached; as determined by a Spectra Max384 Plus plate reader (Molecular Devices, Sunnyvale, Calif.). $OD_{600}$ values were recorded. Cells were pelleted in the plate via centrifugation Heraeus Multifuge X1R centrifuge (Thermo Scientific, Waltham, Mass.) and a M-20 plate rotor (#41102742, Thermo Scientific, Waltham, Mass.) and the resulting supernatants were discarded. The cell pellets were transferred to a Coy Anaerobic Bag (Grass Lake, Mich.) where pellets were resuspended in 0.1 mL anaerobic growth media (described above) that had been to equilibrate to anaerobic conditions for at least 24 hours. The pellet/media suspension was used to inoculate 1.5 mL aliquots of anaerobic culture media in an a VWR 48 deep-well plate (#82004-674, VWR, Radnor, Pa.) to an initial target $OD_{600}$ value of 0.2. The plate was then sealed with a sterile foil seal (60941-076, VWR, Radnor, Pa. and placed into MGC 2.5 L anerobic jar with oxygen scavenging pack (#50-25, #10-01, MGC AnaeroPac System, Japan), which was then sealed. The anaerobic system with removed from the Coy Anaerobic Bag and was placed into a 30° C. incubator and was grown with shaking for 69 hours. At the end of the first anaerobic passage, cells were centrifuged samples of the supernatant were saved for HPLC analysis. The pellets were used to inoculate the subsequent anaerobic passage as dictated by the experiment; subsequent passages were grown 24-72 hours. Three transformants were evaluated for each variant. Select variants were analyzed in a serum vial study.

Serum Vial Growth Procedure 10 mL aliquots of aerobic pre-culture media in 125 mL flask with filtered lids were inoculated with cells grown on a CM+ glucose agar plate (#C3080, Teknova, Hollister, Calif.) spread with 20 µL 3 M sterile sodium acetate (pH 7.0). The aerobic pre-culture was grown aerobically for approximately 24 hours at 30° C. with shaking, until a target $OD_{600}$ value of approximately 1.5 to 2 was achieved. $OD_{600}$ values were determined using Cary 300 spectrophotemeter (Agilent Technologies, Wilmington, Del.) and the values were recorded. Cultures were transferred to 50 mL tubes (#89039-666, VWR, Radnor, Pa.) and cells were pelleted via centrifugation and the supernatant was discarded. Cell pellets were transferred into a Coy Anaerobic Bag (Grass Lake, Mich.) where pellets were resuspended in 1.0 mL anaerobic growth media (SAG-Ura). The resuspended cell pellets were used to inoculate 30 mL SAG-Ura media in 50 mL serum bottles (Wheaton, 223748, Millville, N.J.) to a target initial $OD_{600}$ value of 0.2. All anaerobic media, serum vials, stoppers and crimps were allowed to degas in the anaerobic bag for at least 24 hours prior to inoculation. Serum bottles were stoppered, crimped and transferred out of the anaerobic bag and grown at 30° C. with shaking at 240 rpm. Anaerobic cultures were grown for 24 to 72 hours to a target $OD_{600}$ value of at least 1.2. Additional anaerobic growth steps used the cells from the previous anaerobic culture step as inoculant, with an aliquot of supernatant saved for HPLC analysis. Three transformants were evaluated for each variant.

HPLC Analysis

Samples were taken for HPLC analysis and to obtain $OD_{600}$ values at the end of the anaerobic growth period. HPLC analysis was performed using a Waters 2695 separations unit, 2996 photodiode array detector, and 2414 refractive index detector (Waters, Milford, Mass.) with a Shodex Sugar SH-G pre-column and Shodex Sugar SH1011 separations column (Shodex, JM Science, Grand Island, N.Y.). Compounds were separated by isocratic elution at 0.01 N sulfuric acid with a flow rate of 0.5 mL/min. Chromatograms were analyzed using the Waters Empower Pro software.

TABLE 9

Isobutanol Titer

| Variant | Amino acid SEQ ID NO: | Isobutanol, mM Passage 1 |
|---|---|---|
| K9SB2_SH | 94 | 13.60 ± 7.47 |
| K9ALL3 | 237 | 18.01 ± 5.12 |
| K9JM11 | 202 | 16.40 ± 9.13 |
| K9JM32 | 223 | 6.12 ± 1.78 |
| K9JM33 | 224 | 12.80 ± 5.54 |
| K9JM34 | 225 | 12.27 ± 3.40 |
| K9JM35 | 226 | 2.32 ± 0.24 |
| K9JM36 | 227 | 27.13 ± 14.19 |
| K9JM37 | 228 | 16.09 ± 2.16 |
| K9JM38 | 229 | 11.33 ± 9.41 |
| K9JM39 | 230 | 4.93 ± 4.20 |
| K9JM40 | 231 | 1.04 ± 0.40 |
| K9JM41 | 240 | 18.44 ± 12.83 |
| K9JM42 | 232 | 1.32 ± 0.41 |
| K9JM43 | 233 | 24.01 ± 8.08 |
| K9JM44 | 234 | 25.81 ± 2.42 |
| K9ALL148 | 241 | 29.85 ± 8.08 |
| K9JM148 | 242 | 18.53 ± 7.70 |
| K9ALL156 | 243 | 25.56 ± 16.80 |
| K9JM156 | 244 | 20.99 ± 0.76 |
| K9ALL191 | 245 | 17.94 ± 7.59 |
| K9JM191 | 246 | 16.91 ± 12.73 |
| K9ALL254 | 247 | 25.44 ± 4.69 |
| K9ALL278 | 248 | 19.76 ± 4.06 |
| K9ALL37 | 249 | 7.81 ± 3.51 |
| K9JM37S | 250 | 7.83 ± 4.90 |
| K9ALL66 | 251 | 8.28 ± 5.19 |
| K9JM66 | 252 | 17.98 ± 2.92 |
| K9ALL8Q | 253 | 17.50 ± 8.84 |
| K9JM8Q | 254 | 12.80 ± 6.65 |
| K9ALL45 | 255 | 26.61 ± 8.72 |

Example 6

Kinetic Characterization of K9JM and K9YW Variants

For characterization, genes for KARI variants were subcloned into a E. coli expression plasmid via digestion with PmeI and SfiI and ligation into the corresponding sites of a JEA1.PS.pBAD plasmid (SEQ ID NO: 238). The resulting E. coli plasmids were transformed into an electro-competent strain of E. coli Bw25113 (ΔilvC) (described in U.S. Pat. No. 8,129,162, which is herein incorporated by reference in its entirety) using a BioRad Gene Pulser II (Bio-Rad Laboratories Inc., Hercules, Calif.). The transformed clones were spread on agar plates containing the LB medium and 100 µg/ml ampicillin (#101320-154, Teknova Inc. Hollister, Calif.) and incubated at 37° C. overnight. A single transformant for each strain was streaked out onto LB plates with 100 µg/mL ampicillin. A single colony from each of these plates was used to inoculate 3 mL LB broth with 100 µg/mL ampicillin and 0.025% (w/v) arabinose and grown overnight with shaking at 225 rpm. The cultures were harvested by centrifugation at 4000×g for 5 min. Cells were resuspended in 300 ul BugBuster® Master Mix (EMD Sciences, Catalog #71456-4). The mixture was centrifuged for 10 min at 16,000×g and the supernatant was collected.

Protein concentration of cell lysates was measured using the BioRad protein assay reagent (BioRad Laboratories, Inc., Hercules, Calif. 94547). Between 0.2 and 1.0 micrograms of crude extract protein was added to a reaction buffer consisting of 100 mM MOPS KOH, pH 6.8, 10 mM $MgCl_2$, 1 mM EDTA, 1 mM glucose-6-phosphate (Sigma-Aldrich), 0.2 Units of Leuconostoc mesenteroides glucose-6-phosphate dehydrogenase (Sigma-Aldrich), and various concentrations of NADH or NADPH, to a volume of 90 μL. The reaction was initiated by the addition of 10 μL of [R/S]-acetolactate to a final concentration of 5 mM and a final volume of 100 μL. After 10 min incubations at 30° C., the reaction was quenched by withdrawing 50 μL of the reaction mixture and adding it to 150 μL of 0.1% formic acid. To measure the kinetic parameters for reactions with NADH, the cofactor concentrations used were 0.0003, 0.001, 0.003, 0.01, 0.03, 0.1, 0.3 and 1 mM. The cofactor concentrations employed for reactions with NADPH were 0.0003, 0.001, 0.003, 0.01, 0.03, 0.1, 0.3 and 1 mM.

To analyze for 2,3-dihydroxyisovalerate, 2 μL of the formic acid quenched reaction mixture was injected into a Waters Acquity HPLC equipped with Waters SQD mass spectrometer (Waters Corporation, Milford, Mass.). The chromatography conditions were: flow rate (0.5 ml/min), on a Waters Acquity HSS T3 column (2.1 mm diameter, 100 mm length). Buffer A consisted of 0.1% (v/v) in water, Buffer B was 0.1% formic acid in acetonitrile. The sample was analyzed using 1% buffer B (in buffer A) for 1 min, followed by a linear gradient from 1% buffer B at 1 min to 75% buffer B at 1.5 min. The reaction product, 2,3-dihydroxyisovalerate, was detected by ionization at m/z=133, using electrospay ionization −30 V cone voltage. The amount of product 2,3-dihydroxyisovalerate was calculated by comparison to an authentic standard.

To calculate the $V_{max}$ and cofactor $K_M$ values, the rate data for DHIV formation was fitted to the single substrate Michaelis-Menton equation, using a least-squares regression in Microsoft EXCEL. The kinetic parameters for the reactions with NADPH and with NADH are provided in Table 10. K9SB2_SH derivatives exhibit 1.7-3.2 fold increased $K_M$ for NADPH with less than 1.7 fold changes in the $K_M$ for NADH.

TABLE 10

Kinetic Parameters for E. coli extracts containing K9SB2_SH Variants

| Variant | $V_{max}$ NADPH, U/ml | $K_M$ NADPH, μM | $V_{max}$ NADH, U/mg | $K_M$ NADH, μM | $V_{max}/K_M^{NADH}$ / $V_{max}/K_M^{NADPH}$ |
|---|---|---|---|---|---|
| K9SB2_SH | 0.49 | 62 | 0.56 | 16 | 4.5 |
| K9YW25 | 6.1 | 106 | 7.2 | 15 | 8.5 |
| K9JM11 | 3.4 | 199 | 4.3 | 26 | 9.7 |
| K9YWJM | 3.3 | 166 | 4 | 24 | 8.4 |
| K9YW20 | 4.3 | 164 | 5.6 | 23 | 9.3 |

Example 7

Error Prone PCR of K9 Ursula

Error prone PCR of K9_Ursula (K9SB2+A56V) (SEQ ID NO: 239) was performed to generate a library that can be screened for variants with decreased $K_M$ values for NADH. Mutagenic PCR was performed with the GeneMorph® II EZClone Domain Mutagenesis Kit (Catalog #200552; Agilent Technologies, Stratagene Products Division, La Jolla, Calif.). Primers K9G9_EZ_F1 (AAA CAT GGA AGA ATG TAA GAT GGC; SEQ ID NO: 256) and K9G9_EZ_R1 (TCA GTT GTT AAT CAA CTT GTC TTC G; SEQ ID NO: 257) were commercially synthesized by Integrated DNA Technologies, Inc (Coralville Iowa). Other than the primers, template, and ddH₂O, reagents used here were supplied with the kit indicated above. The mutagenic PCR mixture consisted of 6 μl of K9_Ursula in pBAD.KARI vector (SEQ ID NO: 258) (243 ng/μl), 1.25 μl of each primer (100 ng/μl stocks), 5 μl of 10× Mutazyme II reaction buffer, 1 μl of 40 mM dNTP mix, 1.5 μl of Mutazyme II DNA polymerase, and 34 μl of ddH₂O. The following conditions were used for the PCR reaction: The starting temperature was 95° C. for 2.0 min followed by 30 heating/cooling cycles. Each cycle consisted of 95° C. for 30 sec, 48° C. for 30 sec, and 72° C. for 2.0 min. At the completion of the temperature cycling, the sample was kept at 72° C. for 10.0 min more, and then held awaiting sample recovery at 4° C. The reaction product was separated from the template via agarose gel electrophloresis (1% agarose, 1×TBE buffer) and recovered using the QIAquick Gel Extraction Kit (Cat#28704, Qiagen Incorporated, Valencia, Calif.) as recommended by the manufacturer.

The isolated reaction product was employed as a megaprimer to generate gene libraries in the "EZClone reaction" of the kit indicated above. Other than the megaprimer, template, and ddH₂O, reagents used here were supplied with the kit indicated above. The reaction consisted of 25 μl of the 2×EZClone enzyme mix, 6 μl of megaprimer (99 ng/μl), 2 μl of K9_Ursula in a pBAD.KARI vector (SEQ ID NO: 258) (24 ng/μl), 3 μl of EZClone solution, and 14 μl of ddH₂O. The following conditions were used for the reaction: The starting temperature was 95° C. for 1.0 min followed by 30 heating/cooling cycles. Each cycle consisted of 95° C. for 50 sec, 60° C. for 50 sec, and 68° C. for 10.0 min. At the completion of the temperature cycling, the samples were kept at 72° C. for 10.0 min more, and then held awaiting sample recovery at 4° C. 1 μl of the Dpn I (10 U/μl) was added and the mixture was incubated for 2.5 hours at 37° C. The mixture was concentrated to 8 ul with the DNA Clean & Concentrator™-5 (Cat#D4004, Zymo Research, Irvine Calif.).

4 μl of the Dpn I digested and concentrated "EZClone reaction" product was then transformed into 50 μl XL10-Gold® Ultracompetent E. coli cells (provided in the GeneMorph® II EZClone Domain Mutagenesis Kit) as recommended by the manufacturer. The transformants were spread on agar plates containing the LB medium and 100 μg/ml ampicillin (Cat#L1004, Teknova Inc. Hollister, Calif.), incubated at 37° C. overnight. The resultant library in XL-Gold was scraped off the agar plates with a solution containing M9 salts, combined, diluted into media containing the LB medium and 100 μg/ml ampicillin, and incubated at 37° C. overnight. The library DNA was isolated from the cells with the QIAprep Spin Miniprep Kit (Catalog #2706; Qiagen, Valencia, Calif.) according to the protocol provided by the manufacturer. The amplified library was then used to transform an electro-competent strain of E. coli Bw25113 (ΔilvC) using a BioRad Gene Pulser II (Bio-Rad Laboratories Inc., Hercules, Calif.). The transformed clones were spread on agar plates containing the LB medium and 100 μg/ml ampicillin (#101320-154, Teknova Inc. Hollister, Calif.) and incubated at 37° C. overnight. Clones were employed for high throuphut screening as described in Example 8.

Example 8

Screening K9-Ursula ePCR Library for Variants with Reduced Km NADH

High Throughput Screening Assay of K9-Ursula ePCR Library

High throughput screening of the gene libraries of mutant KARI enzymes was performed as described herein: 10× freezing medium containing 554.4 g/L glycerol, 68 mM of (NH$_4$)$_2$SO$_4$, 4 mM MgSO$_4$, 17 mM sodium citrate, 132 mM KH$_2$PO$_4$, 36 mM K$_2$HPO$_4$ was prepared with molecular pure water and filter-sterilized. Freezing medium was prepared by diluting the 10× freezing medium with the LB medium. An aliquot (200 μL) of the 1× freezing medium was used for each well of the 96-well archive plates (cat #3370, Corning Inc. Corning, N.Y.).

Clones from the LB agar plates were selected and inoculated into the 96-well archive plates containing the freezing medium and grown overnight at 37° C. without shaking. The archive plates were then stored at −80° C. E. coli strain Bw25113(ΔilvC), as described in U.S. Pat. No. 8,129,162, transformed with pBAD-HisB (Invitrogen) was always used as the negative control. The positive control for the library was K9_Ursula in a pBAD.KARI vector (SEQ ID NO: 258) in E. coli strain Bw25113 (ΔilvC)

Clones from archive plates were inoculated into the 96-deep well plates. Each well contained 3.0 μl of cells from thawed archive plates, 200 μl of the LB medium containing 100 μg/ml ampicillin and 0.02% (w/v) arabinose as the inducer. Cells were the grown overnight at 37° C. with 80% humidity while shaking (900 rpm), harvested by centrifugation (3750 rpm, 5 min at 25° C.). (Eppendorf centrifuge, Brinkmann Instruments, Inc. Westbury, N.Y.) and the cell pellet was stored at −20° C. for later analysis.

The assay substrate, (R,S)-acetolactate, was synthesized as described by Aulabaugh and Schloss (Aulabaugh and Schloss, Biochemistry, 29: 2824-2830, 1990). All other chemicals used in the assay were purchased from Sigma. The enzymatic conversion of acetolactate to α,β-dihydroxy-isovalerate by KARI was followed by measuring the oxidation of the cofactor, NADH, from the reaction at 340 nm using a plate reader (Saphire 2, Tecan, Mannedorf, Switzerland). The activity was calculated using the molar extinction coefficient of 6220 M$^{-1}$cm$^{-1}$ NADH. Frozen cell pellet in deep-well plates and BugBuster (Novagen 71456, Darmstadt, Germany) were warmed up at room temperature for 30 min at the same time. 75 μl of 50% BugBuster (v/v in water) was added to each well after 30 min warm-up and cells were suspended using plate shaker. The plates with cell pellet/50% Bug Buster suspension were incubated at room temperature for 30 min. Cell lysate diluted with 75 μL d.d water, resulting in 0.5× lysate. Assays of the diluted cell free extracts were performed at 30° C. in buffer containing 2.4 mM (R/S)-acetolactate, 100 mM HEPES pH 6.8, 100 mM KCl, 10 mM MgCl$_2$, 75 or 200 μM NADH and 6.25 or 12.5 μL of 0.5× cell lysate.

Identification of K9-Urusla Variants: Primary Screening

For each volume of cell lysate, the ratio for the measured rate of NADH oxidation at 75 μM NADH to the measured rate of NADH oxidation at 200 μM NADH was calculated for each variant and positive control well (2 per plate). The mean and standard deviation of ratios for the positive control wells (104 per cell lysate) were calculated.

A variant well was considered to contain an initial hit if the rate ratio was both greater than 0.785 (three standard deviations higher than the positive control mean) and less than 1. Between the two cell lysate volumes, a total of 630 hits were identified from a pool of 5404 potential variants. These initial hits were consolidated, forming a smaller library, CL1, for further analysis.

Identification of K9-Ursula Variants: Secondary Screening

Multiple approaches were employed to evaluate variants from the consolidated library. In one approach, the secondary screen was performed in a manner similar to the primary screen with modifications. The consolidated hit library (CL1) was grown in biological triplicate and cell free extracts were prepared and assayed as described above. Rate data was collected and analyzed as described below. For each volume of cell lysate of the CL1 library, the ratio for the measured rate of NADH oxidation at 75 μM NADH to the measured rate of NADH oxidation at 200 μM NADH was calculated for each variant and positive control well (2 per plate). These ratios were used to calculate Km NADH using the following equation, which can be derived from ratios of Michealis-Menton equations for the two substrate concentrations:

"HTS" $K_m = 75(1-R)/(R-75/200)$ where $R$=rate ratio

A variant well was considered to contain an initial hit if the Km was less than 125 μM and the rate at 200 μM NADH was greater than 0.8. Hits were also collected from variants that exhibited a rate ratio greater that 0.617, regardless of the rate at 200 μM NADH. The ratios and "HTS" Km values for these variants are provided in Table 11.

In another approach, NADH $K_M$ values for variants from the consolidated library were measured in enzymes assays performed manually with a plate reader. Clones from the CL1 archive plates were inoculated into the 96-deep well plates. Each well contained 3.0 μl of cells from thawed archive plates, 200 μl of the LB medium containing 100 μg/ml ampicillin and 0.02% (w/v) arabinose as the inducer. Cells were the grown overnight at 37° C. with 80% humidity while shaking (900 rpm), harvested by centrifugation (3750 rpm, 5 min at 25° C.). (Eppendorf centrifuge, Brinkmann Instruments, Inc. Westbury, N.Y.) and the cell pellet was stored at −20° C. for later analysis.

Cell pellets were thawed and suspended in 20 μL Bug Buster Master Mix (Novagen #) and incubated at room temperature for 15 minutes. 140 μL of 20 mM HEPES (pH 6.8) was added to each well. The plates were centrifuged at 4,000 rpm for 10 minutes at 4° C. 120 μL of the supernatant (CFE) was transferred a 96-well plate (Corning 3370).

To determine the "Plate" $K_M$ for NADH, the CFEs were assayed at various concentrations of NADH (50, 100, 200 and 400 μM). Assays were conducted at 30° C. in a buffer containing 100 mM HEPES (pH 6.8), 10 mM MgCl$_2$, 5.2 mM (R/S)-acetolactate and a concentration of NADH. 180 μL aliquot of the buffer was added to each well of a 96-well flat bottom plate (Corning 3370) and the reaction was initiated with the addition of 20 μL of CFE to each well. The rate of conversion of S-acetolactate to DHIV was determined by measuring the rate of oxidation of NADH to NAD$^+$ at 340 nm using a Spectra Max 384 plus plate reader (Molecular Devices). Total assay length was two minutes, with each well being read every 15 seconds. $K_M$ values were calculated by plotting specific activity (U/mg) vs. cofactor concentration and the data were fit to the Michaelis-Menton equation. The "Plate" $K_M$ values for hits identified by the HTS screening described above are included in Table 11.

Sequence Analysis of K9-Ursula Variants

DNA sequencing of the variants identified in secondary HTS screening was accomplished by using TempliPhi™ (GE Healthcare) with the primers pBAD-For (ATGC-CATAGCATTTTTATCC; SEQ ID NO: 260) and pBAD-Rev (CTGATTTAATCTGTATCAGGCT; SEQ ID NO: 261). The sequences are shown in Table 11.

TABLE 11

KARI Variants

| Rate Ratio | Seq Name | HTS NADH $K_M$ | Plate NADH $K_M$ | Observed Amino Acid Substitutions Relative to SEQ ID NO: 239 |
|---|---|---|---|---|
| 0.92 | T11-1 | 11 | 145 | A73T |
| 0.90 | T11-2 | 14 | 15 | L167M, T191S |
| 0.86 | T11-3 | 21 | 77 | S32Y, V220I |
| 0.86 | T11-4 | 21 | 33 | L243S |
| 0.86 | T11-5 | 22 | 139 | C46S, E200E |
| 0.85 | T11-6 | 23 | na | E68G |
| 0.85 | T11-7 | 25 | na | D14N, I234N, A311V |
| 0.84 | T11-8 | 26 | 157 | none |
| 0.83 | T11-9 | 27 | 201 | none |
| 0.83 | T11-10 | 28 | 149 | F189L |
| 0.82 | T11-11 | 30 | 154 | none |
| 0.81 | T11-12 | 32 | na | K42M, V158D |
| 0.80 | T11-13 | 34 | 109 | G45D |
| 0.80 | T11-14 | 36 | 79 | P124S |
| 0.79 | T11-15 | 37 | na | K42N, D196V, L284C |
| 0.79 | T11-16 | 37 | na | P101S, M132V, K270N |
| 0.79 | T11-17 | 37 | 208 | none |
| 0.79 | T11-18 | 39 | na | K77M |
| 0.78 | T11-19 | 40 | 156 | P125S |
| 0.779 | T11-20 | 41 | 68 | none |
| 0.78 | T11-21 | 42 | na | K136E, A162T, D242V |
| 0.78 | T11-22 | 42 | 79 | F115I, Q213H, Y262N |
| 0.772 | T11-23 | 43 | 6 | none |
| 0.772 | T11-24 | 43 | 203 | none |
| 0.77 | T11-25 | 44 | 15 | F292I |
| 0.74 | T11-26 | 52 | 145 | none |
| 0.74 | T11-27 | 54 | 156 | K238M |
| 0.73 | T11-28 | 56 | 42 | I256T, C156V |
| 0.73 | T11-29 | 57 | 133 | M94L |
| 0.73 | T11-30 | 58 | 200 | F53L, C209S, S330Y |
| 0.73 | T11-31 | 58 | 210 | none |
| 0.72 | T11-32 | 60 | na | Q91R, A210D |
| 0.72 | T11-33 | 61 | 104 | A157S |
| 0.719 | T11-34 | 61 | 444 | none |
| 0.71 | T11-35 | 64 | 149 | N107S |
| 0.71 | T11-36 | 64 | 185 | F53I, K294M |
| 0.71 | T11-37 | 65 | 81 | V56A |
| 0.71 | T11-38 | 65 | 85 | I25N, H235Y |
| 0.71 | T11-39 | 65 | 58 | I84N, F189Y |
| 0.71 | T11-40 | 65 | 178 | none |
| 0.711 | T11-41 | 65 | 105 | none |
| 0.71 | T11-42 | 65 | 120 | Y254H |
| 0.71 | T11-43 | 67 | 81 | V56A |
| 0.70 | T11-44 | 69 | 65 | G114C, E194D, L211S, D225E |
| 0.70 | T11-45 | 69 | 14 | A166T, L171S, T218I, G248C |
| 0.70 | T11-46 | 70 | na | K96E, V123A |
| 0.70 | T11-47 | 70 | 149 | F53I, M108L |
| 0.70 | T11-48 | 70 | 116 | none |
| 0.70 | T11-49 | 71 | 128 | E186D |
| 0.69 | T11-50 | 74 | 185 | F53I |
| 0.69 | T11-51 | 76 | 157 | none |
| 0.69 | T11-52 | 76 | 158 | D302E |
| 0.69 | T11-53 | 76 | 313 | none |
| 0.69 | T11-54 | 76 | 313 | E58D |
| 0.68 | T11-55 | 77 | 79 | G223D |
| 0.68 | T11-56 | 77 | 240 | T93A, G114D, G151S |
| 0.68 | T11-57 | 78 | 158 | D302E |
| 0.68 | T11-58 | 78 | 86 | K42N, K282N, I283F |
| 0.68 | T11-59 | 81 | 292 | G120S |
| 0.68 | T11-60 | 81 | 120 | T191N, Y254H |
| 0.68 | T11-61 | 81 | 223 | V123A, K126M |
| 0.67 | T11-62 | 82 | 217 | K281M |
| 0.67 | T11-63 | 82 | 287 | none |
| 0.67 | T11-64 | 82 | 87 | A174D |
| 0.67 | T11-65 | 82 | 138 | none |
| 0.67 | T11-66 | 83 | 353 | V142F, D168E, E261E |
| 0.67 | T11-67 | 83 | 178 | A92D |
| 0.67 | T11-68 | 83 | 230 | none |
| 0.67 | T11-69 | 84 | 174 | M169K |
| 0.67 | T11-70 | 85 | 153 | E274K |
| 0.67 | T11-71 | 85 | 185 | none |
| 0.67 | T11-72 | 86 | 89 | A176T |
| 0.67 | T11-73 | 86 | 228 | none |
| 0.66 | T11-74 | 87 | 173 | A214V |
| 0.66 | T11-75 | 88 | 195 | I99V, A210T |
| 0.66 | T11-76 | 88 | 188 | T191S |
| 0.66 | T11-77 | 88 | 352 | none |
| 0.66 | T11-78 | 89 | 128 | none |
| 0.66 | T11-79 | 89 | 125 | T187S |
| 0.66 | T11-80 | 90 | 175 | L219W |
| 0.66 | T11-81 | 91 | 149 | T191S |
| 0.65 | T11-82 | 93 | 185 | none |
| 0.65 | T11-83 | 94 | 76 | F53I |
| 0.65 | T11-84 | 95 | 163 | G304C |
| 0.65 | T11-85 | 95 | 352 | A105T |
| 0.65 | T11-86 | 96 | 134 | C209R |
| 0.65 | T11-87 | 97 | 254 | P101S |
| 0.65 | T11-88 | 98 | 141 | A279T |
| 0.65 | T11-89 | 99 | 269 | none |
| 0.65 | T11-90 | 99 | 148 | none |
| 0.64 | T11-91 | 99 | 290 | G120S, A303T, K314M |
| 0.64 | T11-92 | 99 | 228 | none |
| 0.64 | T11-93 | 100 | 157 | none |
| 0.64 | T11-94 | 101 | 231 | I272N |
| 0.64 | T11-95 | 102 | 255 | R181K |
| 0.64 | T11-96 | 102 | 351 | E145V, A214T |
| 0.64 | T11-97 | 103 | 223 | T93I |
| 0.64 | T11-98 | 103 | 251 | none |
| 0.64 | T11-99 | 104 | 226 | D127E |
| 0.64 | T11-100 | 105 | 102 | none |
| 0.63 | T11-101 | 106 | 156 | none |
| 0.63 | T11-102 | 106 | 240 | none |
| 0.63 | T11-103 | 107 | 260 | N40D, T191S |
| 0.63 | T11-104 | 107 | 225 | G207S, E326K |
| 0.63 | T11-105 | 108 | 190 | none |
| 0.63 | T11-106 | 108 | 138 | none |
| 0.63 | T11-107 | 108 | 195 | none |
| 0.63 | T11-108 | 109 | 89 | none |
| 0.63 | T11-109 | 110 | 183 | D295E |
| 0.63 | T11-110 | 111 | 217 | E147D |
| 0.63 | T11-111 | 111 | 126 | G149C, V298A |
| 0.63 | T11-112 | 112 | 313 | none |
| 0.63 | T11-113 | 112 | 236 | none |
| 0.62 | T11-114 | 114 | 255 | T273S |
| 0.62 | T11-115 | 114 | 235 | none |
| 0.62 | T11-116 | 114 | 145 | T131A |
| 0.62 | T11-117 | 115 | 146 | I122F |
| 0.62 | T11-118 | 116 | 136 | none |
| 0.62 | T11-119 | 116 | 157 | D264V |
| 0.62 | T11-120 | 116 | 258 | none |
| 0.62 | T11-121 | 116 | 178 | H118Y, R190G |
| 0.62 | T11-122 | 116 | 197 | L315M |
| 0.62 | T11-123 | 116 | 263 | none |
| 0.62 | T11-124 | 116 | 132 | D264V |
| 0.62 | T11-125 | 118 | 174 | D242N |
| 0.62 | T11-126 | 119 | 168 | none |
| 0.62 | T11-127 | 120 | 245 | none |
| 0.61 | T11-128 | 121 | 123 | M312I |
| 0.61 | T11-129 | 121 | 196 | none |
| 0.61 | T11-130 | 121 | 315 | S285Y |
| 0.61 | T11-131 | 121 | 173 | I234M |
| 0.61 | T11-132 | 122 | 129 | none |
| 0.61 | T11-133 | 122 | 122 | none |
| 0.61 | T11-134 | 123 | 147 | L85M, H140Y, M237L |
| 0.61 | T11-135 | 123 | 132 | none |
| 0.61 | T11-136 | 123 | 220 | none |
| 0.61 | T11-137 | 123 | 198 | none | na—Km value could not be calculated from the data

Example 9

Kinetic Characterization of K9 Ursula Derivatives

Several K9_Ursula derivatives from Example 8 were selected for kinetic characterization. Variants were expressed in *E. coli* and analyzed as described Example 6. The kinetic parameters for the KARI reactions with NADH and NADPH as cofactors are provided in Table 12. Two independent clones containing same amino acid substitution of T191S (#1 and #2) were analyzed. Amino acid substitutions at positions 58 and 191 were observed to lower the $K_M$ of NADH.

TABLE 12

Kinetic Parameters for *E. coli* Extracts Containing K9_Ursula Derivatives

| Substitutions From K9_Ursula | $V_{max}$ NADPH, U/ml | $K_M$ NADPH, μM | $V_{max}$ NADH, U/ml | $K_M$ NADH, μM | $V_{max}/K_M^{NADH}/V_{max}/K_M^{NADPH}$ |
|---|---|---|---|---|---|
| none (K9_Ursula) | 2.6 | 1740 | 5.2 | 154 | 22 |
| T191N | 4.2 | 429 | 5.2 | 52 | 10 |
| E58D | 6.1 | 1904 | 6.5 | 67 | 30 |
| T191S (#1) | 2.0 | 1649 | 3.6 | 82 | 36 |
| T191S (#2) | 2.5 | 1525 | 4.0 | 110 | 22 |
| E274K | 5.5 | 4694 | 5.6 | 115 | 41 |
| T187S | 2.7 | 1275 | 3.6 | 116 | 15 |
| K42N | 3.6 | 2171 | 5.9 | 128 | 28 |
| A105T | 5.0 | 1713 | 8.9 | 129 | 24 |
| A73T | 4.2 | 1868 | 6.6 | 137 | 22 |

TABLE 12-continued

Kinetic Parameters for *E. coli* Extracts Containing K9_Ursula Derivatives

| Substitutions From K9_Ursula | $V_{max}$ NADPH, U/ml | $K_M$ NADPH, μM | $V_{max}$ NADH, U/ml | $K_M$ NADH, μM | $V_{max}/K_M^{NADH}/V_{max}/K_M^{NADPH}$ |
|---|---|---|---|---|---|
| A92D | 2.3 | 2729 | 3.8 | 138 | 32 |
| A279T | 3.3 | 1671 | 6.2 | 138 | 23 |
| A176T | 1.5 | 1235 | 3.4 | 159 | 18 |
| G120S | 2.1 | 2006 | 5.0 | 191 | 25 |
| M169K | 2.4 | 2180 | 4.4 | 196 | 20 |
| R181K | 2.6 | 2009 | 6.1 | 214 | 22 |
| A214V | 4.9 | 3644 | 8.1 | 215 | 28 |

Example 10

Preparation and Characterization of K9 Ursula Derivatives with Substitutions at Position 53

Generation of Position 53 Variants in K9_Ursula

Amino acid replacements at positions 53 were incorporated individually into K9_Ursula via site directed mutagenesis and the resultant variants were expressed in *E. coli* and characterized. Site directed mutagenesis of K9_Ursula was performed with the QuikChange Lightning Site-Directed Mutagenesis Kit (Catalog #210518; Agilent Technologies, Stratagene Products Division, La Jolla, Calif.). Primers listed in Table 13 were commercially synthesized by Integrated DNA Technologies, Inc (Coralville Iowa). Primers were combined into four mixes, as indicated in Table 13 (column labeled "Mix").

TABLE 13

Primer Mixes Employed for Site Directed Mutagenesis

| Mix | SEQ ID NO | Primers | Sequence |
|---|---|---|---|
| 53-1 | 262 | F53I | GGTTGTAACGTTATCATTGGTTTAATCGAAGGTGTGGAGGAGTGG |
| 53-1 | 263 | F53Irev | CCACTCCTCCACACCTTCGATTAAACCAATGATAACGTTACAACC |
| 53-1 | 264 | F53L | GGTTGTAACGTTATCATTGGTTTATTGGAAGGTGTGGAGGAGTGG |
| 53-1 | 265 | F53Lrev | CCACTCCTCCACACCTTCCAATAAACCAATGATAACGTTACAACC |
| 53-1 | 266 | F53S | GGTTGTAACGTTATCATTGGTTTATCCGAAGGTGTGGAGGAGTGG |
| 53-1 | 267 | F53Srev | CCACTCCTCCACACCTTCGGATAAACCAATGATAACGTTACAACC |
| 53-1 | 268 | F53V | GGTTGTAACGTTATCATTGGTTTAGTCGAAGGTGTGGAGGAGTGG |
| 53-1 | 269 | F53Vrev | CCACTCCTCCACACCTTCGACTAAACCAATGATAACGTTACAACC |
| 53-1 | 270 | F53Y | GGTTGTAACGTTATCATTGGTTTATACGAAGGTGTGGAGGAGTGG |
| 53-1 | 271 | F53Yrev | CCACTCCTCCACACCTTCGTATAAACCAATGATAACGTTACAACC |
| 53-2 | 272 | F53D | GGTTGTAACGTTATCATTGGTTTAGACGAAGGTGTGGAGGAGTGG |
| 53-2 | 273 | F53Drev | CCACTCCTCCACACCTTCGTCTAAACCAATGATAACGTTACAACC |
| 53-2 | 274 | F53H | GGTTGTAACGTTATCATTGGTTTACACGAAGGTGTGGAGGAGTGG |
| 53-2 | 275 | F53Hrev | CCACTCCTCCACACCTTCGTGTAAACCAATGATAACGTTACAACC |
| 53-2 | 276 | F53K | GGTTGTAACGTTATCATTGGTTTAAAGGAAGGTGTGGAGGAGTGG |
| 53-2 | 277 | F53Krev | CCACTCCTCCACACCTTCCTTTAAACCAATGATAACGTTACAACC |
| 53-2 | 278 | F53M | GGTTGTAACGTTATCATTGGTTTAATGGAAGGTGTGGAGGAGTGG |
| 53-2 | 279 | F53Mrev | CCACTCCTCCACACCTTCCATTAAACCAATGATAACGTTACAACC |

TABLE 13-continued

Primer Mixes Employed for Site Directed Mutagenesis

| Mix | SEQ ID NO | Primers | Sequence |
|---|---|---|---|
| 53-2 | 280 | F53N | GGTTGTAACGTTATCATTGGTTTAAACGAAGGTGTGGAGGAGTGG |
| 53-2 | 281 | F53Nrev | CCACTCCTCCACACCTTCGTTTAAACCAATGATAACGTTACAACC |
| 53-2 | 282 | F53W | GGTTGTAACGTTATCATTGGTTTATGGGAAGGTGTGGAGGAGTGG |
| 53-2 | 283 | F53Wrev | CCACTCCTCCACACCTTCCCATAAACCAATGATAACGTTACAACC |
| 53-3 | 284 | F53E | GGTTGTAACGTTATCATTGGTTTAGAAGAAGGTGTGGAGGAGTGG |
| 53-3 | 285 | F53Erev | CCACTCCTCCACACCTTCTTCTAAACCAATGATAACGTTACAACC |
| 53-3 | 286 | F53G | GGTTGTAACGTTATCATTGGTTTAGGTGAAGGTGTGGAGGAGTGG |
| 53-3 | 287 | F53Grev | CCACTCCTCCACACCTTCACCTAAACCAATGATAACGTTACAACC |
| 53-3 | 288 | F53P | GGTTGTAACGTTATCATTGGTTTACCAGAAGGTGTGGAGGAGTGG |
| 53-3 | 289 | F53Prev | CCACTCCTCCACACCTTCTGGTAAACCAATGATAACGTTACAACC |
| 53-3 | 290 | F53Q | GGTTGTAACGTTATCATTGGTTTACAAGAAGGTGTGGAGGAGTGG |
| 53-3 | 291 | F53Qrev | CCACTCCTCCACACCTTCTTGTAAACCAATGATAACGTTACAACC |
| 53-4 | 292 | F53A | GGTTGTAACGTTATCATTGGTTTAGCTGAAGGTGTGGAGGAGTGG |
| 53-4 | 293 | F53Arev | CCACTCCTCCACACCTTCAGCTAAACCAATGATAACGTTACAACC |
| 53-4 | 294 | F53C | GGTTGTAACGTTATCATTGGTTTATGTGAAGGTGTGGAGGAGTGG |
| 53-4 | 295 | F53Crev | CCACTCCTCCACACCTTCACATAAACCAATGATAACGTTACAACC |
| 53-4 | 296 | F53R | GGTTGTAACGTTATCATTGGTTTACGTGAAGGTGTGGAGGAGTGG |
| 53-4 | 297 | F53Rrev | CCACTCCTCCACACCTTCACGTAAACCAATGATAACGTTACAACC |
| 53-4 | 298 | F53T | GGTTGTAACGTTATCATTGGTTTAACCGAAGGTGTGGAGGAGTGG |
| 53-4 | 299 | F53Trev | CCACTCCTCCACACCTTCGGTTAAACCAATGATAACGTTACAACC |

Except for the primers, templates, and ddH$_2$O, all reagents used here were supplied with the kit indicated above. The mutagenesis reaction mixture contained 1 μl K9_Ursula in pBAD.KARI (50 ng/μl), 1 μl of each primer mix (11.5 uM total primer concentration), 5 μl of 10× reaction buffer, 1 μl of dNTP mix, 1.5 μl of QuikSolution reagent, 1 μl of QuikChange Lightning Enzyme and 39.5 μl of ddH$_2$O. The following conditions were used for the reaction: The starting temperature was 95° C. for 2 min followed by 18 heating/cooling cycles. Each cycle consisted of 95° C. for 20 sec, 60° C. for 10 sec, and 68° C. for 4.0 min. At the completion of the temperature cycling, the samples were incubated at 68° C. for 5.0 min and then held awaiting sample recovery at 4° C. 2 μl of the Dpn I was added to each reaction and the mixtures were incubated for 30 min at 37° C.

2 μl of each mutagenic reaction was transformed into One Shot® TOP10 Chemically Competent E. coli (Invitrogen, Catalog #C404003) according to the manufacturer's instructions. The transformants were spread on agar plates containing the LB medium and 100 μg/ml ampicillin (Cat#L1004, Teknova Inc. Hollister, Calif.) and incubated at 37° C. overnight. Multiple transformants were then selected for TempliPhi™ (GE Healthcare) based DNA sequencing employing primers pBAD-For (ATGCCATAGCATTTT-TATCC; SEQ ID NO: 260) and pBAD-Rev (CTGATT-TAATCTGTATCAGGCT; SEQ ID NO: 261). Transformants with confirmed KARI sequences were inoculated into LB medium containing 100 μg/ml ampicillin and incubated at 37° C. with shaking at 225 rpm. Plasmid DNA was isolated from the cells with the QIAprep Spin Miniprep Kit (Catalog #2706; Qiagen, Valencia, Calif.) according to the protocol provided by the manufacturer.

Characterization of Position 53 Variants

K9_Ursula and a subset of the derivatives containing substitutions at position 53 were expressed in E. coli strain Bw25113 (ΔilvC) and characterized as described in Example 6. Kinetic parameters for the reactions with NADH and with NADPH are provided in Table 14. K9_Ursula derivatives containing substitutions F53L and F53I were designated as K9_Lucy (SEQ ID NO: 300) and K9_Ilya (SEQ ID NO: 301), respectively (Table 14).

TABLE 14A

Kinetic Parameters for E. coli lysates containing Phe 53 variants

| Substitution relative to SEQ ID NO: 239 | $V_{max}$ NADPH, U/ml | $K_M$ NADPH, μM | $V_{max}$ NADH, U/ml | $K_M$ NADH, μM | $V_{max}/K_M^{NADH}/V_{max}/K_M^{NADPH}$ |
|---|---|---|---|---|---|
| None (K9_Ursala) | 4.1 | 1095 | 11.1 | 159 | 19 |
| F53L (K9_Lucy) | 10.8 | 324 | 13.4 | 26 | 15 |

TABLE 14A-continued

Kinetic Parameters for E. coli lysates containing Phe 53 variants

| Substitution relative to SEQ ID NO: 239 | $V_{max}$ NADPH, U/ml | $K_M$ NADPH, μM | $V_{max}$ NADH, U/ml | $K_M$ NADH, μM | $V_{max}/K_M^{NADH}/$ $V_{max}/K_M^{NADPH}$ |
|---|---|---|---|---|---|
| F53I (K9_Ilya) | 27.3 | 2558 | 13.7 | 27 | 48 |
| F53M | 9.6 | 313 | 13.9 | 41 | 11 |
| F53V | 13.5 | 431 | 18.3 | 48 | 12 |
| F53P (K9_Pria) | 10.1 | 439 | 14.7 | 40 | 16 |
| F53S | 6.7 | 762 | 10.4 | 104 | 11 |
| F53A | 9.0 | 1132 | 10.1 | 75 | 17 |
| F53E | 8.9 | 383 | 12.2 | 47 | 11 |
| F53Q | 7.4 | 1272 | 13.7 | 108 | 22 |

TABLE 14B

Amino Acid Substitutions in K9_Ursula, K9_Lucy, K9_Ilya

| Variant | Amino Acid Seq ID No: | Amino Acid Substitutions |
|---|---|---|
| K9_Ursula | 239 | Y53F, S56V, K57E, S58E, N87P |
| K9_Lucy | 300 | Y53L, S56V, K57E, S58E, N87P |
| K9_Ilya | 301 | Y53I, S56V, K57E, S58E, N87P |

Purification and Kinetic Analysis of K9_Lucy and K9_Ilya

For expression and characterization, E. coli plasmids (pBAD.KARI) were used to transform an electro-competent strain of E. coli Bw25113 (ΔilvC) using a BioRad Gene Pulser II (Bio-Rad Laboratories Inc., Hercules, Calif.). The transformed clones were spread on agar plates containing the LB medium and 100 μg/ml ampicillin (#101320-154, Teknova Inc. Hollister, Calif.) and incubated at 37° C. overnight. A single transformant for each strain was streaked out onto LB plates with 100 μg/mL ampicillin. A single colony from each of these plates was used to inoculate 10 mL LB broth with 100 μg/mL ampicillin. These cultures were grown for 8 hours at 37° C. with shaking in 125 mL baffled flasks with vented, filtered lids. 200 μL of this culture was used to inoculate two 500 mL baffled flasks with filtered vented lids containing LB broth with 100 μg/mL ampicillin and 0.2% (w/v) arabinose. The expression cultures were grown for 16-18 hours at 37° C. with shaking. Cells were harvested in 40 mL aliquots via centrifugation; the supernatant was discarded and cell pellets were frozen at −80° C. until purification.

K9_Lucy and K9_Ilya variants were purified using the same process. Two cell pellets, representing 40 mL cell culture aliquots each, were resuspended in 4 mL Bug Buster Master Mix (Novagen 71456, Darmstadt, Germany) and incubated for 15 minutes at room temperature followed by 15 minutes at 60° C. Denatured proteins and cell debris was pelleted by centrifugation at 7,000 rpm for 30 minutes and 4° C. The supernatant was decanted, save and filtered through a Acrodisc 0.2 μm syringe filter (PN4192, Pall, Ann Arbor, Mich.). K9_Lucy and K9_Ilya was purified from the filtered heat treated cell free extract using a GE Healthcare HiLoad 26/60 Superdex 200 gel filtration column (17-1071-01, Buckinghamshire, England). The column was pre-equilibrated with 0.2 CV equilibration with 50 mM HEPES (pH 7.5) 5 mM MgCl$_2$ buffer at a 2.0 mL/min flow rate prior to protein loading. K9_Lucy and K9_Ilya were eluted over a 1.5 CV isocratic step consisting of 50 mM HEPES (pH 7.5) 5 mM MgCl$_2$ buffer at a 2.0 mL/min flow rate. Fractions 2.5 mL in volume were collected using a Frac-950 fraction collector (Buckinghamshire, England) in a serpentine pattern. Variants all eluted between fractions D5-E5 or D6-E4. Fractions were pooled using a 15 mL Amicon Ultra YM-30 spin filter (UFC903008, Millipore, Billercia, Mass.) and washed with 10 mL 100 mM HEPES (pH 6.8) and 10 mM MgCl$_2$ buffer. Filtrate was discarded and the purified protein was eluted from the membrane using 1 mL buffer containing 100 mM HEPES (pH 6.8) and 10 mM MgCl$_2$. Kinetic parameters for purified proteins (Table 15) were determined in the same manner as described in Example 6 for E. coli crude extracts.

TABLE 15

Kinetic Values for Purified K9_Ursula Derivatives

| Variant | $V_{max}$ NADPH, U/mg | $K_m$ NADPH, μM | $V_{max}$ NADH, U/mg | $K_m$ NADH, μM | $V_{max}/K_M^{NADH}/$ $V_{max}/K_M^{NADPH}$ |
|---|---|---|---|---|---|
| K9_Lucy | 3.9 | 408 | 5.9 | 32 | 19 |
| K9_Ilya | 4.8 | 378 | 6.7 | 31 | 17 |

Example 11

Site Directed Mutagenesis of K9YW and K9JM Variants and Derivatives

Site directed mutagenesis of the K9SB2_SH derivatives was performed to to incorporate additional amino acid replacements. Mutagenesis was performed as described in Example 10 with modifications. For mutagenesis reactions performed with variants in a yeast shuttle plasmid, the 68° C. step during the temperature cycling was increased from 4.0 min to 10 min.

Variant K9ALL3 (in a yeast shuttle plasmid) was derived from K9YW25 employing primers AlaLL1 (CCAGAT-GAAGCTCAGGCTTTGTTGTACAAAAACGACATC-GAACC; SEQ ID NO: 692) and AlaLL1rev (GGT TCG ATG TCG TTT TTG TAC AAC AAA GCC TGA GCT TCA TCT GG; SEQ ID NO: 693). The mutagenesis reaction contained 1 μl K9YW25_DHAD (generated via mutagenesis of K9SB2_SH_DHAD in Example 1) (50 ng/μl), 1 ul of a mix of primers ALL1 and ALL1rev (10 uM each), 5 μl of 10× reaction buffer, 1 μl of dNTP mix, 1.5 μl of QuikSolution reagent, 1 μl of QuikChange Lightning Enzyme and 39.5 μl of ddH$_2$O. For expression in E. coli, the gene for K9ALL3 was subcloned into the PmeI and SfiI sites of the JEA1.PS.pBAD plasmid (SEQ ID NO: 238).

Variant K9ALL191 (in an E. coli expression plasmid) was derived from K9ALL3 employing primers T191S (CTTG-GAAACTACCTTCAGATCCGAAACTGAAACCGACTT-GTTC; SEQ ID NO: 694) and T191Srev (GAA CAA GTC GGT TTC AGT TTC GGA TCT GAA GGT AGT TTC CAA G; SEQ ID NO: 695). The mutagenesis reaction contained 1 μl K9ALL3 in a pBAD.KARI (SEQ ID NO: 530) plasmid (50 ng/μl), 1 μl of a mix of primers (10 uM each), 5 μl of 10× reaction buffer, 1 μl of dNTP mix, 1.5 μl of QuikSolution reagent, 1 μl of QuikChange Lightning Enzyme and 39.5 μl of ddH$_2$O.

Variant K9ALL254 (in an E. coli expression plasmid) was derived from K9ALL3 employing primers Y254F (GTTTCTCCGGTATGCGTTTCTCTATCTC-CAACACTG; SEQ ID NO: 696) and Y254Frev (CAGT- GTTGGAGATAGAGAAACGCATACCGGAGAAAC; SEQ ID NO: 697). The mutagenesis reaction contained 1 µl K9ALL3 in a pBAD.KARI plasmid (50 ng/µl), 1 µl of a mix of the above primers (10 uM each), 5 µl of 10× reaction buffer, 1 µl of dNTP mix, 1.5 µl of QuikSolution reagent, 1 µl of QuikChange Lightning Enzyme and 39.5 µl of ddH$_2$O.

Variant K9ALL278 (in an *E. coli* expression plasmid) was derived from K9ALL3 employing primers K278M (CAT-TACTGAAGATACCAAGATGGCTAT-GAAGAAGATTTTGTCTGAC; SEQ ID NO: 698) and K278Mrev (GTCAGACAAAATCTTCTTCATAGC-CATCTTGGTATCTTCAGTAATG; SEQ ID NO: 699). The mutagenesis reaction contained 1 µl K9ALL3 in a pBAD-.KARI plasmid (50 ng/µl), 1 µl of a mix of the above primers (10 uM each), 5 µl of 10× reaction buffer, 1 µl of dNTP mix, 1.5 µl of QuikSolution reagent, 1 µl of QuikChange Lightning Enzyme and 39.5 µl of ddH$_2$O.

Variant K9JM191 (in an *E. coli* expression plasmid) was derived from K9JM11 employing primers T191S (CTTG-GAAACTACCTTCAGATCCGAAACTGAAACCGACTT-GTTC; SEQ ID NO: 700) and T191Srev (GAA CAA GTC GGT TTC AGT TTC GGA TCT GAA GGT AGT TTC CAA G; SEQ ID NO: 701). The mutagenesis reaction contained 1 µl K9JM11 in pBAD.KARI (SEQ ID NO: 259) (50 ng/µl), 1 µl of mix of primers (10 uM each), 5 µl of 10× reaction buffer, 1 µl of dNTP mix, 1.5 µl of QuikSolution reagent, 1 µl of QuikChange Lightning Enzyme and 39.5 µl of ddH$_2$O. For yeast studies, K9JM191 was subcloned into the PmeI and SfiI sites of K9_David_DHAD.

Variant K9YW25-T191S (in an *E. coli* expression plasmid) was derived from K9YW25 employing primers T191S (CTTGGAAACTACCTTCAGATCCGAAACTGAAAC-CGACTTGTTC; SEQ ID NO: 702) and T191Srev (GAA CAA GTC GGT TTC AGT TTC GGA TCT GAA GGT AGT TTC CAA G; SEQ ID NO: 703). The mutagenesis reaction contained 1 µl K9YW25 in pBAD.KARI (50 ng/µl), 1 µl of mix of T191S and T191Srev (10 uM each), 2.5 µl of 10× reaction buffer, 0.5 µl of dNTP mix, 0.75 µl of QuikSolution reagent, 0.5 µl of QuikChange Lightning Enzyme and 19.25 µl of ddH$_2$O. The following conditions were used for the reaction: The starting temperature was 95° C. for 2 min followed by 18 heating/cooling cycles. Each cycle consisted of 95° C. for 20 sec, 60° C. for 10 sec, and 68° C. for 3.0 min. At the completion of the temperature cycling, the samples were incubated at 68° C. for 5.0 min and then held awaiting sample recovery at 4° C.

Variant K9ALL258 (in a yeast shuttle plasmid) was derived from K9ALL3 employing primers 258-1 (GGTAT-GCGTTACTCTATCTCCTCCACTGCTGAATACGGT-GACTAC; SEQ ID NO: 704) and 258-1r (GTA GTC ACC GTA TTC AGC AGT GGA GGA GAT AGA GTA ACG CAT ACC; SEQ ID NO: 705). The mutagenesis reaction contained 1 µl pLH689::ALL3 (SEQ ID NO: 304) (50 ng/µl), 1 ul of a mix of primers 258-1 and 258-1r (10 uM each), 5 µl of 10× reaction buffer, 1 µl of dNTP mix, 1.5 µl of QuikSolution reagent, 1 µl of QuikChange Lightning Enzyme and 39.5 µl of ddH2O.

Additional variants in yeast shuttle plasmids were prepared employing in mutagenesis reactions containing mixtures of K9ALL3 and K9JM11 templates. Each reaction contained 0.5 µl K9JM11_DHAD (50 ng/µl), 0.5 µl K9ALL3_DHAD (SEQ ID NO: 533) (50 ng/µl), 1 µl of a primer mix listed in Table (10 uM each primer), 5 µl of 10× reaction buffer, 1 µl of dNTP mix, 1.5 µl of QuikSolution reagent, 1 µl of QuikChange Lightning Enzyme and 39.5 µl of ddH$_2$O.

TABLE 16

Primer Mixes for Site Directed Mutagenesis of K9ALL3/K9JM11

| Mix | Primers | Sequence |
|---|---|---|
| 37 | H37N1 | GTTCTCAAGGTCACGCTAATGCCCTGAATGCTAAGGAATC (SEQ ID NO: 554) |
| 37 | H37N1rev | GATTCCTTAGCATTCAGGGCATTAGCGTGACCTTGAGAAC (SEQ ID NO: 555) |
| 50/45 | G45C | CCTGAATGCTAAGGAATCCTGTTGTAACGTTATCATTGG (SEQ ID NO: 556) |
| 50/45 | G45Crev | CCAATGATAACGTTACAACAGGATTCCTTAGCATTCAGG (SEQ ID NO: 557) |
| 50/45 | I50V-FA | GGTTGTAACGTTATCGTTGGTTTATTCGAAGGTGCGGAGG (SEQ ID NO: 558) |
| 50/45 | I50V-FArev | CCTCCGCACCTTCGAATAAACCAACGATAACGTTACAACC (SEQ ID NO: 559) |
| 66 | G66A | GAAAAGAGCTGAAGAACAAGCTTTCGAAGTCTACACC (SEQ ID NO: 560) |
| 66 | G66Arev | GGTGTAGACTTCGAAAGCTTGTTCTTCAGCTCTTTTC (SEQ ID NO: 561) |
| 148 | E148G | GTTAGATCCGAATACGAAGGTGGTAAAGGTGTCCCATGCTTGG (SEQ ID NO: 562) |
| 148 | E148Grev | CCAAGCATGGGACACCTTTACCACCTTCGTATTCGGATCTAAC (SEQ ID NO: 563) |
| 148 | E148Q | GTTAGATCCGAATACGAACAAGGTAAAGGTGTCCCATGCTTGG (SEQ ID NO: 564) |

TABLE 16-continued

Primer Mixes for Site Directed Mutagenesis of K9ALL3/K9JM11

| Mix | Primers | Sequence |
|---|---|---|
| 148 | E148Qrev | CCAAGCATGGGACACCTTTACCTTGTTCGTATTCGGATCTAAC (SEQ ID NO: 565) |
| 156 | V156A | GTGTCCCATGCTTGGCCGCTGTCGAACAAGACGC (SEQ ID NO: 566) |
| 156 | V156Arev | GCGTCTTGTTCGACAGCGGCCAAGCATGGGACAC (SEQ ID NO: 567) |
| 191 | T191S | CTTGGAAACTACCTTCAGATCCGAAACTGAAACCGACTTGTTC (SEQ ID NO: 568) |
| 191 | T191Srev | GAACAAGTCGGTTTCAGTTTCGGATCTGAAGGTAGTTTCCAAG (SEQ ID NO: 569) |
| 254 | Y254F | GTTTCTCCGGTATGCGTTTCTCTATCTCCAACACTG (SEQ ID NO: 570) |
| 254 | Y254Frev | CAGTGTTGGAGATAGAGAAACGCATACCGGAGAAAC (SEQ ID NO: 571) |

The amino acid substitutions of the variants prepared are provided in Table 17.

TABLE 17

Amino Acid Substitutions of K9SB2_SH Variants

| Variant | Amino Acid Seq ID No: | Amino Acid Substitutions |
|---|---|---|
| K9ALL3 | 237 | Y53F, S56A, K57E, S58E, N87P, K90A, T93L, M94L |
| K9ALL8Q | 253 | Y53F, S56A, K57E, S58E, N87P, K90A, T93L, M94L, E148Q |
| K9ALL37 | 249 | Y53F, S56A, K57E, S58E, N87P, K90A, T93L, M94L, H37N |
| K9ALL45 | 255 | Y53F, S56A, K57E, S58E, N87P, K90A, T93L, M94L, G45C |
| K9ALL66 | 251 | Y53F, S56A, K57E, S58E, N87P, K90A, T93L, M94L, G66A |
| K9ALL148 | 241 | Y53F, S56A, K57E, S58E, N87P, K90A, T93L, M94L, E148G |
| K9ALL156 | 243 | Y53F, S56A, K57E, S58E, N87P, K90A, T93L, M94L, V156A |
| K9ALL191 | 245 | Y53F, S56A, K57E, S58E, N87P, K90A, T93L, M94L, T191S |
| K9ALL254 | 247 | Y53F, S56A, K57E, S58E, N87P, K90A, T93L, M94L, Y254F |
| K9ALL278 | 248 | Y53F, S56A, K57E, S58E, N87P, K90A, T93L, M94L, K278M |
| K9JM37S | 250 | Y53F, S56A, K57E, S58E, N87P, K90Y, M94L, H37N |
| K9JM66 | 252 | Y53F, S56A, K57E, S58E, N87P, K90Y, M94L, G66A |
| K9JM148 | 242 | Y53F, S56A, K57E, S58E, N87P, K90Y, M94L, E148Q |
| K9JM156 | 244 | Y53F, S56A, K57E, S58E, N87P, K90Y, M94L, V156A |
| K9JM191 | 246 | Y53F, S56A, K57E, S58E, N87P, K90Y, M94L, T191S |
| K9YW25 | 132 | Y53F, S56A, K57E, S58E, N87P, K90A, T93L |
| K9YW25-T191S | 303 | Y53F, S56A, K57E, S58E, N87P, K90A, T93L, T191S |
| K9ALL258 | 302 | Y53F, S56A, K57E, S58E, N87P, K90A, T93L, M94L, N258S |
| K9JM8Q | 254 | Y53F, S56A, K57E, S58E, N87P, K90Y, M94L, E148Q |

Example 12

Kinetic Characterization of Site Directed K9 Variants

A subset of the variants prepared in Example 11 were expressed in E. coli and analyzed as described Example 6. Three additional variants (K9JM36, K9JM43, K9JM44) described in Example 3 were subcloned into the PmeI and SfiI sites of the JEA1.PS.pBAD plasmid (SEQ ID NO: 238), expressed in E. coli, and analyzed in the same manner. The kinetic parameters for the KARI reactions with NADH and NADPH as cofactors are provided in Table 18.

TABLE 18

Kinetic Parameters for E. coli extracts containing K9 Variants

| Variant | $V_{max}$ NADPH, U/ml | $K_M$ NADPH, μM | $V_{max}$ NADH, U/ml | $K_M$ NADH, μM | $V_{max}/K_M^{NADH}/V_{max}/K_M^{NADPH}$ |
|---|---|---|---|---|---|
| K9SB2_SH | 0.49 | 62 | 0.56 | 16 | 5 |
| K9ALL3 | 4.3 | 204 | 4.5 | 21 | 10 |
| K9ALL191 | 6.0 | 129 | 5.7 | 14 | 9 |
| K9ALL254 | 4.9 | 216 | 5.2 | 21 | 11 |
| K9JM11 | 3.8 | 205 | 4.3 | 26 | 9 |
| K9JM191 | 4.8 | 120 | 5.3 | 17 | 8 |
| K9YW25 | 10.0 | 130 | 10.5 | 14 | 10 |
| K9YW25-191 | 13.5 | 78 | 13.3 | 13 | 6 |
| K9JM36 | 3.5 | 232 | 4.1 | 28 | 10 |
| K9JM43 | 3.9 | 211 | 4.0 | 28 | 8 |
| K9JM44 | 5.3 | 215 | 5.3 | 25 | 9 |

Example 13

Construction of a Site-Saturation Gene Library Targeting Position 158 and Screening the Isobutanol Production of the Resultant Variants in PNY2068

The forward primer mixture (called K9_158 f in this example) containing primers encoding all 19 individual amino acid changes at the amino acid corresponding to position 158 of the wild-type Anaerostipes caccae KARI sequence (SEQ ID NO: 93) (Table 19) and the reverse primer K9_309T_111711r: CTTTCTCATAGCCTTAGTGTGGAC (SEQ ID NO: 415; called K9_309Tr in this example) were employed to create a single-site saturation library targeting the position of 158 of K9 KARI. A plasmid containing the variant K9SB2_SH (plasmid K8SB2_SH_81; SEQ ID NO: 532) was used as the template.

In brief, a megaprimer was prepared through a regular PCR. The megaprimer PCR mixture consisted of 45 µl of SuperMix (Invitrogen, Carlsbad, Calif., #10572063), 2.0 µl K9_158 f (20 µM), 2.0 µl K9_309Tr (20 µM) and 1.0 µl template (50 ng/µl). The PCR program for making the megaprimer is: the starting temperature was 95° C. for 1.0 min followed by 35 heating/cooling cycles. Each cycle consisted of 95° C. for 20 sec, 55° C. for 20 sec, and 72° C. for 1.0 min. The megaprimer was then used to introduce mutation into K9SB2_SH using the same procedure as shown in Example 5 (U.S. application Ser. No. 13/428,585, filed Mar. 23, 2012, incorporated herein by reference). The PCR product was transformed into E. coli. Bw25113 (Δ ilvC) and clones were sequenced.

The resultant variants with unique sequences together with K8SB2_SH_81 were analyzed for isobutanol production in yeast strain PNY2068 (triple for each mutant). The plasmid having K9 KARI variants and the plasmid pYZ067ΔADHΔKivD were transformed into the yeast strain PNY2068. The transformed cells were plated on synthetic medium without histidine and uracil (1% ethanol as carbon source). Three transformants were transferred to fresh plates of the same media. The transformants were tested for isobutanol production under anaerobic conditions in 48-well plates (Axygen, Union City, Calif. #391-05-061). The promising transformants were further tested for isobutanol production under anaerobic conditions in 15 ml serum vials.

Yeast colonies from the transformation on SE-Ura-His plates appeared after 5-7 days. The three colonies from each variant were patched onto fresh SE-Ura-His plates, and incubated at 30° C. for 3 days.

Growth Media and Procedure

Two types of media were used during the growth procedure of yeast strains: an aerobic pre-culture media and an anaerobic culture media. All chemicals were obtained from Sigma unless otherwise noted (St. Louis, Mo.).

Aerobic pre-culture media (SE-Ura): 6.7 g/L yeast nitrogen base without amino acids (Difco, 291940, Sparks, Md.), 1.4 g/L yeast synthetic drop-out medium supplement without histidine, leucine, tryptophan and uracil, 0.2% ethanol, 0.2% glucose, 0.01% w/v leucine, 0.002% w/v histidine, and 0.002% w/v tryptophan.

Anaerobic culture media (SEG-Ura-His): 50 mM MES (pH 5.5, 6.7 g/L yeast nitrogen base without amino acids (Difco, 291940, Sparks, Md.), 1.4 g/L yeast synthetic drop-out medium supplement without histidine, leucine, tryptophan and uracil, 0.1% ethanol, 3% glucose, 0.01% leucine, 0.002% w/v histidine, 0.002% tryptophan, 30 mg/L nicotinic acid, 30 mg/L thiamine and 10 mg/L ergosterol made up in 50/50 v/v Tween/ethanol solution.

The patched cells were inoculated into 48-well plates. Each well contains 1.5 ml aerobic media. The plates were covered with permeable foils and grown at 30° C. with shaking overnight. The cell density ($OD_{600}$) was then measured. The amount of cells to make a 1.5 ml of cell suspension (in anaerobic media) with the final $OD_{600}$=0.2 for each well were calculated, and a 1.5 ml cell suspension was prepared with anaerobic media and added into each well. Oxygen in 48-well plates was removed using an anaerobic chamber following the manufacturer's protocol (Coy Laboratory Products Inc. Grass Lake, Mich.). Cells were then grown at 30° C. with shaking for two days. After two days of anaerobic growth, the cell density ($OD_{600}$) was then measured. Cells were centrifuged at 4,000 g for 5 min and the supernatant was collected for the isobutanol measurement using liquid chromatography/mass spectrometry (LC/MS).

Based on 48-well plate data, the top performers were chosen and patched. The patched cells were inoculated into 24-well plates. Each well contains 3.0 ml aerobic media. The plates were covered with permeable foils and grown at 30° C. with shaking overnight. The cell density ($OD_{600}$) was then measured. The amount of cells to make a 10 ml of cell suspension (in anaerobic media) with the final $OD_{600}$=0.2 for each vial were calculated, and a 10 ml cell suspension was prepared with anaerobic media and added into each vial. Each vial was capped and cells were then grown at 30° C. with shaking for two days. After two days of anaerobic growth, the cell density ($OD_{600}$) was then measured. Cells were centrifuged at 4,000 g for 5 min and the supernatant was collected for the isobutanol measurement using LC/MS.

LC/MS Analysis of Yeast Strains with K9 KARI Mutants

Samples were taken for LC/MS analysis at the end of the anaerobic growth period. LC/MS analysis was performed using a Waters AcQuity UPLC separations unit and AcQuity TQD triple quad mass spectrometer (Waters, Milford, Mass.) with a Waters AcQuity UPLC HSS T3 separations column (Waters, Milford, Mass.). Compounds were separated using a reverse phase gradient of water (+0.1% formic acid) and acetonitrile (+0.1% formic acid) starting with 99% aqueous and ending with 99% organic, at a flow rate of 0.5 mL/min. Chromatograms were analyzed using Waters Masslynx 4.1 software (Waters, Milford, Mass.). Micro molar yields for isobutanol were calculated using Waters Quanlynx software (Waters, Milford, Mass.) using a calibration curve of triplicate analyses of standards.

TABLE 19

Forward Primers

| Targeted position(s) of K9-KARI | | Primers |
|---|---|---|
| 158 | K9_158C_011212f | GCTTGGTTGCTTGTGAACAAGAC (SEQ ID NO: 416) |
| | K9_158S_011212f | GCTTGGTTGCTTCTGAACAAGAC (SEQ ID NO: 417) |
| | K9_158L_022312f | GCTTGGTTGCTTTGGAACAAGAC (SEQ ID NO: 418) |
| | K9_158F_022312f | GCTTGGTTGCTTTTGAACAAGAC (SEQ ID NO: 419) |
| | K9_158Y_022312f | GCTTGGTTGCTTATGAACAAGAC (SEQ ID NO: 420) |
| | K9_158W_022312f | GCTTGGTTGCTTGGGAACAAGAC (SEQ ID NO: 421) |
| | K9_158P_022312f | GCTTGGTTGCTCCAGAACAAGAC (SEQ ID NO: 422) |
| | K9_158H_022312f | GCTTGGTTGCTCATGAACAAGAC (SEQ ID NO: 423) |
| | K9_158Q_022312f | GCTTGGTTGCTCAAGAACAAGAC (SEQ ID NO: 424) |
| | K9_158A_022312f | GCTTGGTTGCTGCTGAACAAGAC (SEQ ID NO: 425) |
| | K9_158D_022312f | GCTTGGTTGCTGATGAACAAGAC (SEQ ID NO: 426) |
| | K9_158E_022312f | GCTTGGTTGCTGAAGAACAAGAC (SEQ ID NO: 427) |
| | K9_158G_022312f | GCTTGGTTGCTGGTGAACAAGAC (SEQ ID NO: 428) |

TABLE 19-continued

Forward Primers

| Targeted position(s) of K9-KARI | Primers | |
|---|---|---|
| K9_158I_022312f | GCTTGGTTGCTATTGAACAAGAC | (SEQ ID NO: 429) |
| K9_158M_022312f | GCTTGGTTGCTATGGAACAAGAC | (SEQ ID NO: 430) |
| K9_158T_022312f | GCTTGGTTGCTACTGAACAAGAC | (SEQ ID NO: 431) |
| K9_158R_022312f | GCTTGGTTGCTAGAGAACAAGAC | (SEQ ID NO: 432) |
| K9_158K_022312f | GCTTGGTTGCTAAGGAACAAGAC | (SEQ ID NO: 433) |
| K9_158N_022312f | GCTTGGTTGCTAACGAACAAGAC | (SEQ ID NO: 434) |

TABLE 20

Isobutanol production of some K9 variants in stain PNY2068

| Variant | Amino Acid Seq ID No: | Nucleic Acid SEQ ID NO: | Repeat | Isobutanol titer (mM) |
|---|---|---|---|---|
| ECB11 | 534 | 512 | 1 | 69.8 |
| | | | 2 | 74.3 |
| | | | 3 | 66.6 |
| EC2A2 | 535 | 513 | 1 | 73.1 |
| | | | 2 | 67.5 |
| | | | 3 | 72.2 |
| EC2B12 | 536 | 514 | 1 | 71.2 |
| | | | 2 | 71.5 |
| | | | 3 | 71.0 |
| K9SB2_SH | 94 | — | 1 | 63.6 |
| | | | 2 | 66.2 |
| | | | 3 | 57.7 |

Example 14

Construction of a Site-Saturation Gene Library Targeting Position 67 and Screening the Isobutanol Production of the Resultant Variants in PNY2115

The forward primer mixture (called K9_67 f in this example) containing primers encoding all 19 individual amino acid changes at the amino acid corresponding to position 67 of the wild-type *Anaerostipes caccae* KARI sequence (SEQ ID NO: 93) (Table 21) and the reverse primer K9_309T_111711r: CTTTCTCATAGCCTTAGT-GTGGAC (SEQ ID NO: 415; called K9_309Tr in this example) were employed to create a single-site saturation library targeting the position of 67 of K9 KARI. A plasmid containing the variant K9SB2_SH (K8SB2_SH_81; SEQ ID NO: 532) was used as the template.

In brief, a megaprimer was prepared through a regular PCR. The megaprimer PCR mixture consisted of 45 µl of SuperMix (Invitrogen, Carlsbad, Calif., #10572063), 2.0 µl K9_67 f (20 µM), 2.0 µl K9_309Tr (20 µM) and 1.0 µl template (50 ng/µl). The PCR program for making the megaprimer is: the starting temperature was 95° C. for 1.0 min followed by 35 heating/cooling cycles. Each cycle consisted of 95° C. for 20 sec, 55° C. for 20 sec, and 72° C. for 1.0 min. The PCR product was cleaned up using a DNA cleaning kit (Cat#D4003, Zymo Research, Orange, Calif.) as recommended by the manufacturer.

The Megaprimers were then used to generate a gene library using the QuickChange Lightning kit (Stratagene #210518, La Jolla Calif.). A 25 µl reaction mixture contained: 2.5 µl of 10× reaction buffer, 0.5 µl of 50 ng/µl template, 20.25 µl of Megaprimer, 0.5 µl of 40 mM dNTP mix, 0.5 µl enzyme mixture and 0.75 µl QuickSolution. Except for the Megaprimer and the templates, all reagents used here were supplied with the kit indicated above. This reaction mixture was placed in a thin well 200 µl-capacity PCR tube and the following reactions were used for the PCR: The starting temperature was 95° C. for 2 min followed by 20 heating/cooling cycles. Each cycle consisted of 95° C. for 20 sec, 60° C. for 10 sec, and 68° C. for 5 min. At the completion of the temperature cycling, the samples were kept at 68° C. for 10 min more, and then held at 4° C. for later processing. 0.5 µl Dpn I was added into the finished PCR reaction mixture and then incubated at 37° C. for 2 hr. The PCR product was cleaned up using a DNA cleaning kit (Cat#D4003, Zymo Research, Orange, Calif.) as recommended by the manufacturer. The PCR product was transformed into *E. coli*. Bw25113 (Δ ilvC) and clones were sequenced.

The resultant variants with unique sequences together with K8SB2_ SH_81 were analyzed for isobutanol production in yeast strain PNY2115 (triple for each mutant). The plasmid having K9 KARI variants and the plasmid pYZ067ΔADHΔKivD were transformed into the yeast host PNY2115. The transformed cells were plated on synthetic medium without histidine and uracil (1% ethanol as carbon source). Three transformants were transferred to fresh plates of the same media. The transformants were tested for isobutanol production under anaerobic conditions in 48-well plates (Axygen, Union City, Calif. #391-05-061). The promising transformants were further tested for isobutanol production under anaerobic conditions in 15 ml serum vials.

Yeast colonies from the transformation on SE-Ura-His plates appeared after 5-7 days. The three colonies from each variant were patched onto fresh SE-Ura-His plates, and incubated at 30° C. for 3 days.

Growth Media and Procedure

Two types of media were used during the growth procedure of yeast strains: an aerobic pre-culture media and an anaerobic culture media. All chemicals were obtained from Sigma unless otherwise noted (St. Louis, Mo.).

Aerobic pre-culture media (SE-Ura): 6.7 g/L yeast nitrogen base without amino acids (Difco, 291940, Sparks, Md.), 1.4 g/L yeast synthetic drop-out medium supplement without histidine, leucine, tryptophan and uracil, 0.2% ethanol, 0.2% glucose, 0.01% w/v leucine, 0.002% w/v histidine, and 0.002% w/v tryptophan.

Anaerobic culture media (SEG-Ura-His): 50 mM MES (pH 5.5, 6.7 g/L yeast nitrogen base without amino acids (Difco, 291940, Sparks, Md.), 1.4 g/L yeast synthetic drop-out medium supplement without histidine, leucine, tryptophan and uracil, 0.1% ethanol, 3% glucose, 0.01% leucine, 0.002% w/v histidine, 0.002% tryptophan, 30 mg/L nicotinic acid, 30 mg/L thiamine and 10 mg/L ergosterol made up in 50/50 v/v Tween/ethanol solution.

The patched cells were inoculated into 48-well plates. Each well contains 1.5 ml aerobic media. The plates were covered with permeable foils and grown at 30° C. with shaking overnight. The cell density ($OD_{600}$) was then measured. The amount of cells to make a 1.5 ml of cell suspension (in anaerobic media) with the final $OD_{600}$=0.2 for each well were calculated, and a 1.5 ml cell suspension was prepared with anaerobic media and added into each well. 48-well plates were sealed with aluminum foil. Cells were then grown at 30° C. with shaking for three days. After three days of anaerobic growth, the cell density ($OD_{600}$) was then measured. Cells were centrifuged at 4,000 g for 5 min and the supernatant was collected for the isobutanol measurement using LC/MS.

Based on 48-well plate data, the top performers were chosen and patched. The patched cells were inoculated into 24-well plates. Each well contains 3.0 ml aerobic media. The plates were covered with permeable foils and grown at 30° C. with shaking overnight. The cell density ($OD_{600}$) was then measured. The amount of cells to make a 10 ml of cell suspension (in anaerobic media) with the final $OD_{600}$=0.2 for each vial were calculated, and a 10 ml cell suspension was prepared with anaerobic media and added into each vial. Each vial was capped and cells were then grown at 30° C. with shaking for three days. After three days of anaerobic growth, the cell density ($OD_{600}$) was then measured. Cells were centrifuged at 4,000 g for 5 min and the supernatant was collected for the isobutanol measurement using LC/MS.

LC/MS Analysis of Yeast Strains with K9 KARI Mutants

Samples were taken for LC/MS analysis at the end of the anaerobic growth period. LC/MS analysis was performed using a Waters AcQuity UPLC separations unit and AcQuity TQD triple quad mass spectrometer (Waters, Milford, Mass.) with a Waters AcQuity UPLC HSS T3 separations column (Waters, Milford, Mass.). Compounds were separated using a reverse phase gradient of water (+0.1% formic acid) and acetonitrile (+0.1% formic acid) starting with 99% aqueous and ending with 99% organic, at a flow rate of 0.5 mL/min. Chromatograms were analyzed using Waters Masslynx 4.1 software (Waters, Milford, Mass.). Micro molar yields for isobutanol were calculated using Waters Quanlynx software (Waters, Milford, Mass.) using a calibration curve of triplicate analyses of standards.

TABLE 22

Forward Primers

| Targeted position(s) of K9-KARI | | Primers |
|---|---|---|
| 67 | K9_67L_011212f | GAAGAACAAGGTTTGGAAGTC (SEQ ID NO: 435) |
| | K9_67C_011212f | GAAGAACAAGGTTGTGAAGTC (SEQ ID NO: 436) |
| | K9_67S_011212f | GAAGAACAAGGTTCTGAAGTC (SEQ ID NO: 437) |
| | K9_67Y_011212f | GAAGAACAAGGTTATGAAGTC (SEQ ID NO: 438) |
| | K9_67W_011212f | GAAGAACAAGGTTGGGAAGTC (SEQ ID NO: 439) |
| | K9_67V_011212f | GAAGAACAAGGTGTTGAAGTC (SEQ ID NO: 440) |
| | K9_67A_011212f | GAAGAACAAGGTGCTGAAGTC (SEQ ID NO: 441) |
| | K9_67D_011212f | GAAGAACAAGGTGATGAAGTC (SEQ ID NO: 442) |
| | K9_67E_011212f | GAAGAACAAGGTGAAGAAGTC (SEQ ID NO: 443) |
| | K9_67G_011212f | GAAGAACAAGGTGGTGAAGTC (SEQ ID NO: 444) |
| | K9_67I_011212f | GAAGAACAAGGTATTGAAGTC (SEQ ID NO: 445) |
| | K9_67M_011212f | GAAGAACAAGGTATGGAAGTC (SEQ ID NO: 446) |
| | K9_67T_011212f | GAAGAACAAGGTACTGAAGTC (SEQ ID NO: 447) |
| | K9_67R_011212f | GAAGAACAAGGTAGAGAAGTC (SEQ ID NO: 448) |

TABLE 22-continued

Forward Primers

| Targeted position(s) of K9-KARI | | Primers |
|---|---|---|
| | K9_67K_011212f | GAAGAACAAGGTAAGGAAGTC (SEQ ID NO: 449) |
| | K9_67N_011212f | GAAGAACAAGGTAACGAAGTC (SEQ ID NO: 450) |
| | K9_67Q_011212f | GAAGAACAAGGTCAAGAAGTC (SEQ ID NO: 451) |
| | K9_67H_011212f | GAAGAACAAGGTCATGAAGTC (SEQ ID NO: 452) |
| | K9_67P_011212f | GAAGAACAAGGTCCAGAAGTC (SEQ ID NO: 453) |

TABLE 23

Isobutanol production of some K9 variants in stain PNY2115

| Variant | Amino Acid Seq ID No: | Nucleic Acid SEQ ID NO: | Repeat | Isobutanol titer (mM) |
|---|---|---|---|---|
| EGC10 | 537 | 515 | 1 | 86.0 |
| | | | 2 | 94.7 |
| | | | 3 | 101.6 |
| EGG8 | 539 | 517 | 1 | 103.6 |
| | | | 2 | 116.6 |
| | | | 3 | 96.9 |
| EGD9 | 538 | 516 | 1 | 112.4 |
| | | | 2 | 103.6 |
| | | | 3 | 102.3 |
| K9SB2_SH | 94 | — | 1 | 99.0 |
| | | | 2 | 90.4 |
| | | | 3 | 84.2 |

Example 15

Construction of a Site-Saturation Gene Library Targeting Position 162 and Screening the Isobutanol Production of the Resultant Variants in PNY2115

The forward primer mixture (called K9_162 f in this example) containing primers encoding all 19 individual amino acid changes at the amino acid corresponding to position 162 of the wild-type *Anaerostipes caccae* KARI sequence (SEQ ID NO: 93) (Table 24 and the reverse primer K9_309T_111711r: CTTTCTCATAGCCTTAGTGTGGAC (SEQ ID NO: 415; called K9_309Tr in this example) were employed to create a single-site saturation library targeting the position of 162 of K9 KARI. A plasmid containing the variant K9SB2_SH (or K8SB2_SH_81) was used as the template.

In brief, a megaprimer was prepared through a regular PCR. The megaprimer PCR mixture consisted of 45 μl of SuperMix (Invitrogen, Carlsbad, Calif., #10572063), 2.0 μl K9_162 f (20 μM), 2.0 μl K9_309Tr (20 μM) and 1.0 μl template (50 ng/μl). The PCR program for making the megaprimer is: the starting temperature was 95° C. for 1.0 min followed by 35 heating/cooling cycles. Each cycle consisted of 95° C. for 20 sec, 55° C. for 20 sec, and 72° C. for 1.0 min. The PCR product was cleaned up using a DNA cleaning kit (Cat#D4003, Zymo Research, Orange, Calif.) as recommended by the manufacturer.

The Megaprimers were then used to generate a gene library using the QuickChange Lightning kit (Stratagene #210518, La Jolla Calif.). A 25 μl reaction mixture contained: 2.5 μl of 10× reaction buffer, 0.5 μl of 50 ng/μl template, 20.25 μl of Megaprimer, 0.5 μl of 40 mM dNTP mix, 0.5 μl enzyme mixture and 0.75 μl QuickSolution. Except for the Megaprimer and the templates, all reagents used here were supplied with the kit indicated above. This reaction mixture was placed in a thin well 200 μl-capacity PCR tube and the following reactions were used for the PCR: The starting temperature was 95° C. for 2 min followed by 20 heating/cooling cycles. Each cycle consisted of 95° C. for 20 sec, 60° C. for 10 sec, and 68° C. for 5 min. At the completion of the temperature cycling, the samples were kept at 68° C. for 10 min more, and then held at 4° C. for later processing. 0.5 μl Dpn I was added into the finished PCR reaction mixture and then incubated at 37° C. for 2 hr. The PCR product was cleaned up using a DNA cleaning kit (Cat#D4003, Zymo Research, Orange, Calif.) as recommended by the manufacturer. The PCR product was transformed into E. coli. Bw25113 (Δ ilvC) and clones were sequenced.

The resultant variants with unique sequences together with K8SB2_ SH_81 were analyzed for isobutanol production in yeast strain PNY2115 (triple for each mutant). The plasmid having K9 KARI variants and the plasmid pYZ067ΔADHΔKivD were transformed into the yeast host PNY2115. The transformed cells were plated on synthetic medium without histidine and uracil (1% ethanol as carbon source). Three transformants were transferred to fresh plates of the same media. The transformants were tested for isobutanol production under anaerobic conditions in 48-well plates (Axygen, Union City, Calif. #391-05-061). The promising transformants were further tested for isobutanol production under anaerobic conditions in 15 ml serum vials.

Yeast colonies from the transformation on SE-Ura-His plates appeared after 5-7 days. The three colonies from each variant were patched onto fresh SE-Ura-His plates, and incubated at 30° C. for 3 days.

Growth Media and Procedure

Two types of media were used during the growth procedure of yeast strains: an aerobic pre-culture media and an anaerobic culture media. All chemicals were obtained from Sigma unless otherwise noted (St. Louis, Mo.).

Aerobic pre-culture media (SE-Ura): 6.7 g/L yeast nitrogen base without amino acids (Difco, 291940, Sparks, Md.), 1.4 g/L yeast synthetic drop-out medium supplement without histidine, leucine, tryptophan and uracil, 0.2% ethanol, 0.2% glucose, 0.01% w/v leucine, 0.002% w/v histidine, and 0.002% w/v tryptophan.

Anaerobic culture media (SEG-Ura-His): 50 mM MES (pH 5.5, 6.7 g/L yeast nitrogen base without amino acids (Difco, 291940, Sparks, Md.), 1.4 g/L yeast synthetic drop-out medium supplement without histidine, leucine, tryptophan and uracil, 0.1% ethanol, 3% glucose, 0.01% leucine, 0.002% w/v histidine, 0.002% tryptophan, 30 mg/L nicotinic acid, 30 mg/L thiamine and 10 mg/L ergosterol made up in 50/50 v/v Tween/ethanol solution.

The patched cells were inoculated into 48-well plates. Each well contains 1.5 ml aerobic media. The plates were covered with permeable foils and grown at 30° C. with shaking overnight. The cell density ($OD_{600}$) was then measured. The amount of cells to make a 1.5 ml of cell suspension (in anaerobic media) with the final $OD_{600}$=0.2 for each well were calculated, and a 1.5 ml cell suspension was prepared with anaerobic media and added into each well. 48-well plates were sealed with aluminum foil. Cells were then grown at 30° C. with shaking for three days. After three days of anaerobic growth, the cell density ($OD_{600}$) was then measured. Cells were centrifuged at 4,000 g for 5 min and the supernatant was collected for the isobutanol measurement using LC/MS.

Based on 48-well plate data, the top performers were chosen and patched. The patched cells were inoculated into 24-well plates. Each well contains 3.0 ml aerobic media. The plates were covered with permeable foils and grown at 30° C. with shaking overnight. The cell density ($OD_{600}$) was then measured. The amount of cells to make a 10 ml of cell suspension (in anaerobic media) with the final $OD_{600}$=0.2 for each vial were calculated, and a 10 ml cell suspension was prepared with anaerobic media and added into each vial. Each vial was capped and cells were then grown at 30° C. with shaking for three days. After three days of anaerobic growth, the cell density ($OD_{600}$) was then measured. Cells were centrifuged at 4,000 g for 5 min and the supernatant was collected for the isobutanol measurement using LC/MS.

LC/MS Analysis of Yeast Strains with K9 KARI Mutants

Samples were taken for LC/MS analysis at the end of the anaerobic growth period. LC/MS analysis was performed using a Waters AcQuity UPLC separations unit and AcQuity TQD triple quad mass spectrometer (Waters, Milford, Mass.) with a Waters AcQuity UPLC HSS T3 separations column (Waters, Milford, Mass.). Compounds were separated using a reverse phase gradient of water (+0.1% formic acid) and acetonitrile (+0.1% formic acid) starting with 99% aqueous and ending with 99% organic, at a flow rate of 0.5 mL/min. Chromatograms were analyzed using Waters Masslynx 4.1 software (Waters, Milford, Mass.). Micro molar yields for isobutanol were calculated using Waters Quanlynx software (Waters, Milford, Mass.) using a calibration curve of triplicate analyses of standards.

TABLE 25

Forward Primers

| Targeted position(s) of K9-KARI | | Primers |
|---|---|---|
| 162 | K9_162V_011212f | GTCGAACAAGACGTTACTGGC (SEQ ID NO: 454) |
| | K9_162D_011212f | GTCGAACAAGACGATACTGGC (SEQ ID NO: 455) |
| | K9_162E_011212f | GTCGAACAAGACGAAACTGGC (SEQ ID NO: 456) |
| | K9_162G_011212f | GTCGAACAAGACGGTACTGGC (SEQ ID NO: 457) |
| | K9_162F_011212f | GTCGAACAAGACTTTACTGGC (SEQ ID NO: 458) |
| | K9_162L_011212f | GTCGAACAAGACTTGACTGGC (SEQ ID NO: 459) |
| | K9_162C_011212f | GTCGAACAAGACTGTACTGGC (SEQ ID NO: 460) |
| | K9_162S_011212f | GTCGAACAAGACTCTACTGGC (SEQ ID NO: 461) |
| | K9_162Y_011212f | GTCGAACAAGACTATACTGGC (SEQ ID NO: 462) |
| | K9_162W_011212f | GTCGAACAAGACTGGACTGGC (SEQ ID NO: 463) |
| | K9_162I_011212f | GTCGAACAAGACATTACTGGC (SEQ ID NO: 464) |
| | K9_162M_011212f | GTCGAACAAGACATGACTGGC (SEQ ID NO: 465) |
| | K9_162T_011212f | GTCGAACAAGACACTACTGGC (SEQ ID NO: 466) |
| | K9_162R_011212f | GTCGAACAAGACAGAACTGGC (SEQ ID NO: 467) |

TABLE 25-continued

Forward Primers

| Targeted position(s) of K9-KARI | Primers | |
|---|---|---|
| | K9_162K_011212f | GTCGAACAAGACAAGACTGGC (SEQ ID NO: 468) |
| | K9_162N_011212f | GTCGAACAAGACAACACTGGC (SEQ ID NO: 469) |
| | K9_162Q_011212f | GTCGAACAAGACCAAACTGGC (SEQ ID NO: 470) |
| | K9_162H_011212f | GTCGAACAAGACCATACTGGC (SEQ ID NO: 471) |
| | K9_162P_011212f | GTCGAACAAGACCCAACTGGC (SEQ ID NO: 472) |

TABLE 26

Isobutanol production of some K9 variants in strain PNY2115

| Variant | Amino Acid Seq ID No: | Nucleic Acid SEQ ID NO: | Repeat | Isobutanol titer (mM) |
|---|---|---|---|---|
| EHG1 | 540 | 518 | 1 | 69.9 |
| | | | 2 | 74.8 |
| | | | 3 | 72.1 |
| EHG2 | 541 | 519 | 1 | 80.8 |
| | | | 2 | 70.5 |
| | | | 3 | 65.8 |
| EHH12 | 545 | 523 | 1 | 73.9 |
| | | | 2 | 79.2 |
| | | | 3 | 70.1 |
| EHH10 | 544 | 522 | 1 | 75.9 |
| | | | 2 | 81.9 |
| | | | 3 | 79.4 |
| EHH6 | 542 | 520 | 1 | 78.7 |
| | | | 2 | 82.6 |
| | | | 3 | 92.6 |
| EHH9 | 543 | 521 | 1 | <10 |
| | | | 2 | 86.7 |
| | | | 3 | 86.8 |
| K9SB2_SH | 94 | — | 1 | 67.3 |
| | | | 2 | 60.7 |
| | | | 3 | 76.1 |

Example 16

Construction of a Site-Saturation Gene Library Targeting Position 312 and Screening the Isobutanol Production of the Resultant Variants in PNY2115

The forward primer mixture (called K9_312r in this example) containing primers encoding all 19 individual amino acid changes at the amino acid corresponding to position 312 of the wild-type *Anaerostipes caccae* KARI sequence (SEQ ID NO: 93) (Table 27) and the reverse primer K9_219_032212f: GAAGCTGCTAAGAAGGCT-GACATC (SEQ ID NO: 473; called K9_219f in this example) were employed to create a single-site saturation library targeting the position of 312 of K9 KARI. A plasmid containing the variant K9SB2_SH (or K8SB2_SH_81) was used as the template.

In brief, a megaprimer was prepared through a regular PCR. The megaprimer PCR mixture consisted of 45 µl of SuperMix (Invitrogen, Carlsbad, Calif., #10572063), 2.0 µl K9_219 f (20 µM), 2.0 µl K9_312r (20 µM) and 1.0 µl template (50 ng/µl). The PCR program for making the megaprimer is: the starting temperature was 95° C. for 1.0 min followed by 35 heating/cooling cycles. Each cycle consisted of 95° C. for 20 sec, 55° C. for 20 sec, and 72° C. for 1.0 min. The PCR product was cleaned up using a DNA cleaning kit (Cat#D4003, Zymo Research, Orange, Calif.) as recommended by the manufacturer.

The Megaprimers were then used to generate a gene library using the QuickChange Lightning kit (Stratagene #210518, La Jolla Calif.). A 25 µl reaction mixture contained: 2.5 µl of 10× reaction buffer, 0.5 µl of 50 ng/µl template, 20.25 µl of Megaprimer, 0.5 µl of 40 mM dNTP mix, 0.5 µl enzyme mixture and 0.75 µl QuickSolution. Except for the Megaprimer and the templates, all reagents used here were supplied with the kit indicated above. This reaction mixture was placed in a thin well 200 µl-capacity PCR tube and the following reactions were used for the PCR: The starting temperature was 95° C. for 2 min followed by 20 heating/cooling cycles. Each cycle consisted of 95° C. for 20 sec, 60° C. for 10 sec, and 68° C. for 5 min. At the completion of the temperature cycling, the samples were kept at 68° C. for 10 min more, and then held at 4° C. for later processing. 0.5 µl Dpn I was added into the finished PCR reaction mixture and then incubated at 37° C. for 2 hr. The PCR product was cleaned up using a DNA cleaning kit (Cat#D4003, Zymo Research, Orange, Calif.) as recommended by the manufacturer. The PCR product was transformed into *E. coli*. Bw25113 (Δ ilvC) and clones were sequenced.

The resultant variants with unique sequences together with K8SB2_ SH_81 were analyzed for isobutanol production in yeast strain PNY2115 (triple for each mutant). The plasmid having K9 KARI variants and the plasmid pYZ067ΔADHΔKivD were transformed into the yeast host PNY2115. The transformed cells were plated on synthetic medium without histidine and uracil (1% ethanol as carbon source). Three transformants were transferred to fresh plates of the same media. The transformants were tested for isobutanol production under anaerobic conditions in 48-well plates (Axygen, Union City, Calif. #391-05-061). The promising transformants were further tested for isobutanol production under anaerobic conditions in 15 ml serum vials.

Yeast colonies from the transformation on SE-Ura-His plates appeared after 5-7 days. The three colonies from each variant were patched onto fresh SE-Ura-His plates, and incubated at 30° C. for 3 days.

Growth Media and Procedure

Two types of media were used during the growth procedure of yeast strains: an aerobic pre-culture media and an anaerobic culture media. All chemicals were obtained from Sigma unless otherwise noted (St. Louis, Mo.).

Aerobic pre-culture media (SE-Ura): 6.7 g/L yeast nitrogen base without amino acids (Difco, 291940, Sparks, Md.), 1.4 g/L yeast synthetic drop-out medium supplement without histidine, leucine, tryptophan and uracil, 0.2% ethanol, 0.2% glucose, 0.01% w/v leucine, 0.002% w/v histidine, and 0.002% w/v tryptophan.

Anaerobic culture media (SEG-Ura-His): 50 mM MES (pH 5.5, 6.7 g/L yeast nitrogen base without amino acids (Difco, 291940, Sparks, Md.), 1.4 g/L yeast synthetic drop-out medium supplement without histidine, leucine, tryptophan and uracil, 0.1% ethanol, 3% glucose, 0.01% leucine, 0.002% w/v histidine, 0.002% tryptophan, 30 mg/L nicotinic acid, 30 mg/L thiamine and 10 mg/L ergosterol made up in 50/50 v/v Tween/ethanol solution.

The patched cells were inoculated into 48-well plates. Each well contains 1.5 ml aerobic media. The plates were covered with permeable foils and grown at 30° C. with shaking overnight. The cell density ($OD_{600}$) was then measured. The amount of cells to make a 1.5 ml of cell suspension (in anaerobic media) with the final $OD_{600}$=0.2 for each well were calculated, and a 1.5 ml cell suspension was prepared with anaerobic media and added into each well. 48-well plates were sealed with aluminum foil. Cells were then grown at 30° C. with shaking for three days. After three days of anaerobic growth, the cell density ($OD_{600}$) was then measured. Cells were centrifuged at 4,000 g for 5 min and the supernatant was collected for the isobutanol measurement using LC/MS.

Based on 48-well plate data, the top performers were chosen and patched. The patched cells were inoculated into 24-well plates. Each well contains 3.0 ml aerobic media. The plates were covered with permeable foils and grown at 30° C. with shaking overnight. The cell density ($OD_{600}$) was then measured. The amount of cells to make a 10 ml of cell suspension (in anaerobic media) with the final $OD_{600}$=0.2 for each vial were calculated, and a 10 ml cell suspension was prepared with anaerobic media and added into each vial. Each vial was capped and cells were then grown at 30° C. with shaking for three days. After three days of anaerobic growth, the cell density ($OD_{600}$) was then measured. Cells were centrifuged at 4,000 g for 5 min and the supernatant was collected for the isobutanol measurement using LC/MS.

LC/MS Analysis of Yeast Strains with K9 KARI Mutants

Samples were taken for LC/MS analysis at the end of the anaerobic growth period. LC/MS analysis was performed using a Waters AcQuity UPLC separations unit and AcQuity TQD triple quad mass spectrometer (Waters, Milford, Mass.) with a Waters AcQuity UPLC HSS T3 separations column (Waters, Milford, Mass.). Compounds were separated using a reverse phase gradient of water (+0.1% formic acid) and acetonitrile (+0.1% formic acid) starting with 99% aqueous and ending with 99% organic, at a flow rate of 0.5 mL/min. Chromatograms were analyzed using Waters Masslynx 4.1 software (Waters, Milford, Mass.). Micro molar yields for isobutanol were calculated using Waters Quanlynx software (Waters, Milford, Mass.) using a calibration curve of triplicate analyses of standards.

TABLE 28

Forward Primers

| Targeted position(s) of K9-KARI | Primers | |
|---|---|---|
| 312 | K9_312Y_030812r | GGAGGCCAACTTTCTTATAGCC (SEQ ID NO: 474) |
| | K9_312A_030812r | GGAGGCCAACTTTCTAGCAGCC (SEQ ID NO: 475) |
| | K9_312L_030812r | GGAGGCCAACTTTCTTAAAGCC (SEQ ID NO: 476) |
| | K9_312R_030812r | GGAGGCCAACTTTCTTCTAGCC (SEQ ID NO: 477) |
| | K9_312K_030812r | GGAGGCCAACTTTCTTTTAGCC (SEQ ID NO: 478) |
| | K9_312F_050712r | GGAGGCCAACTTTCTAAAAGCC (SEQ ID NO: 479) |
| | K9_312P_050712r | GGAGGCCAACTTTCTAGGAGCC (SEQ ID NO: 480) |
| | K9_312N_050712r | GGAGGCCAACTTTCTATTAGCC (SEQ ID NO: 481) |

TABLE 28-continued

Forward Primers

| Targeted position(s) of K9-KARI | Primers | |
|---|---|---|
| | K9_312I_050712r | GGAGGCCAACTTTCTAATAGCC (SEQ ID NO: 482) |
| | K9_312C_050712r | GGAGGCCAACTTTCTACAAGCC (SEQ ID NO: 483) |
| | K9_312H_050712r | GGAGGCCAACTTTCTATGAGCC (SEQ ID NO: 484) |
| | K9_312V_050712r | GGAGGCCAACTTTCTAACAGCC (SEQ ID NO: 485) |
| | K9_312D_050712r | GGAGGCCAACTTTCTATCAGCC (SEQ ID NO: 486) |
| | K9_312G_050712r | GGAGGCCAACTTTCTACCAGCC (SEQ ID NO: 487) |
| | K9_312S_050712r | GGAGGCCAACTTTCTAGAAGCC (SEQ ID NO: 488) |
| | K9_312T_050712r | GGAGGCCAACTTTCTAGTAGCC (SEQ ID NO: 489) |
| | K9_312Q_050712r | GGAGGCCAACTTTCTTTGAGCC (SEQ ID NO: 490) |
| | K9_312E_050712r | GGAGGCCAACTTTCTTTCAGCC (SEQ ID NO: 491) |
| | K9_312W_050712r | GGAGGCCAACTTTCTCCAAGCC (SEQ ID NO: 492) |

TABLE 29

Isobutanol production of K9 variants in strain PNY2115

| Variant | Amino Acid Seq ID No: | Nucleic Acid SEQ ID NO: | Repeat | Isobutanol titer (mM) |
|---|---|---|---|---|
| EKC5 | 546 | 524 | 1 | 94.8 |
| | | | 2 | 85.0 |
| | | | 3 | 90.8 |
| K9SB2_SH | 94 | — | 1 | 81.6 |
| | | | 2 | 79.4 |
| | | | 3 | 79.5 |

TABLE 30

Isobutanol production of K9 variants in strain PNY2115

| Variant | Amino Acid Seq ID No: | Nucleic Acid SEQ ID NO: | Repeat | Isobutanol titer (mM) |
|---|---|---|---|---|
| EKG4 | 547 | 525 | 1 | 64.4 |
| | | | 2 | 57.6 |
| | | | 3 | 62.7 |
| K9SB2_SH | 94 | — | 1 | 62.6 |
| | | | 2 | 57.4 |
| | | | 3 | 32.5 |

Example 17

Construction of a Site-Saturation Gene Library Targeting Position 169 and Screening the Isobutanol Production of the Resultant Variants in PNY2115

The forward primer mixture (called K9_169 f in this example) containing primers encoding all 19 individual amino acid changes at the amino acid corresponding to position 169 of the wild-type *Anaerostipes caccae* KARI sequence (SEQ ID NO: 93) (Table 31) and the reverse primer K9_309T_111711r: CTTTCTCATAGCCTTAGT-GTGGAC (SEQ ID NO: 415; called K9_309Tr in this example) were employed to create a single-site saturation library targeting the position of 169 of K9 KARI. A plasmid containing the variant K9SB2_SH (or K8SB2_SH_81) was used as the template.

In brief, a megaprimer was prepared through a regular PCR. The megaprimer PCR mixture consisted of 45 μl of SuperMix (Invitrogen, Carlsbad, Calif., #10572063), 2.0 μl K9_169 f (20 μM), 2.0 μl K9_309Tr (20 μM) and 1.0 μl template (50 ng/μl). The PCR program for making the megaprimer is: the starting temperature was 95° C. for 1.0 min followed by 35 heating/cooling cycles. Each cycle consisted of 95° C. for 20 sec, 55° C. for 20 sec, and 72° C. for 1.0 min. The PCR product was cleaned up using a DNA cleaning kit (Cat#D4003, Zymo Research, Orange, Calif.) as recommended by the manufacturer.

The Megaprimers were then used to generate a gene library using the QuickChange Lightning kit (Stratagene #210518, La Jolla Calif.). A 25 μl reaction mixture contained: 2.5 μl of 10× reaction buffer, 0.5 μl of 50 ng/μl template, 20.25 μl of Megaprimer, 0.5 μl of 40 mM dNTP mix, 0.5 μl enzyme mixture and 0.75 μl QuickSolution. Except for the Megaprimer and the templates, all reagents used here were supplied with the kit indicated above. This reaction mixture was placed in a thin well 200 μl-capacity PCR tube and the following reactions were used for the PCR: The starting temperature was 95° C. for 2 min followed by 20 heating/cooling cycles. Each cycle consisted of 95° C. for 20 sec, 60° C. for 10 sec, and 68° C. for 5 min. At the completion of the temperature cycling, the samples were kept at 68° C. for 10 min more, and then held at 4° C. for later processing. 0.5 μl Dpn I was added into the finished PCR reaction mixture and then incubated at 37° C. for 2 hr. The PCR product was cleaned up using a DNA cleaning kit (Cat#D4003, Zymo Research, Orange, Calif.) as recommended by the manufacturer. The PCR product was transformed into *E. coli.* Bw25113 (Δ ilvC) and clones were sequenced.

The resultant variants with unique sequences together with K8SB2_SH_81 were analyzed for isobutanol production in yeast strain PNY2115 (triple for each mutant). The plasmid having K9 KARI variants and the plasmid pYZ067ΔADHΔKivD were transformed into the yeast host PNY2115. The transformed cells were plated on synthetic medium without histidine and uracil (1% ethanol as carbon source). Three transformants were transferred to fresh plates of the same media. The transformants were tested for isobutanol production under anaerobic conditions in 48-well plates (Axygen, Union City, Calif. #391-05-061). The promising transformants were further tested for isobutanol production under anaerobic conditions in 15 ml serum vials.

Yeast colonies from the transformation on SE-Ura-His plates appeared after 5-7 days. The three colonies from each variant were patched onto fresh SE-Ura-His plates, and incubated at 30° C. for 3 days.

Growth Media and Procedure

Two types of media were used during the growth procedure of yeast strains: an aerobic pre-culture media and an anaerobic culture media. All chemicals were obtained from Sigma unless otherwise noted (St. Louis, Mo.).

Aerobic pre-culture media (SE-Ura): 6.7 g/L yeast nitrogen base without amino acids (Difco, 291940, Sparks, Md.), 1.4 g/L yeast synthetic drop-out medium supplement without histidine, leucine, tryptophan and uracil, 0.2% ethanol, 0.2% glucose, 0.01% w/v leucine, 0.002% w/v histidine, and 0.002% w/v tryptophan.

Anaerobic culture media (SEG-Ura-His): 50 mM MES (pH 5.5, 6.7 g/L yeast nitrogen base without amino acids (Difco, 291940, Sparks, Md.), 1.4 g/L yeast synthetic drop-out medium supplement without histidine, leucine, tryptophan and uracil, 0.1% ethanol, 3% glucose, 0.01% leucine, 0.002% w/v histidine, 0.002% tryptophan, 30 mg/L nicotinic acid, 30 mg/L thiamine and 10 mg/L ergosterol made up in 50/50 v/v Tween/ethanol solution.

The patched cells were inoculated into 48-well plates. Each well contains 1.5 ml aerobic media. The plates were covered with permeable foils and grown at 30° C. with shaking overnight. The cell density ($OD_{600}$) was then measured. The amount of cells to make a 1.5 ml of cell suspension (in anaerobic media) with the final $OD_{600}$=0.2 for each well were calculated, and a 1.5 ml cell suspension was prepared with anaerobic media and added into each well. 48-well plates were sealed with aluminum foil. Cells were then grown at 30° C. with shaking for three days. After three days of anaerobic growth, the cell density ($OD_{600}$) was then measured. Cells were centrifuged at 4,000 g for 5 min and the supernatant was collected for the isobutanol measurement using LC/MS.

Based on 48-well plate data, the top performers were chosen and patched. The patched cells were inoculated into 24-well plates. Each well contains 3.0 ml aerobic media. The plates were covered with permeable foils and grown at 30° C. with shaking overnight. The cell density ($OD_{600}$) was then measured. The amount of cells to make a 10 ml of cell suspension (in anaerobic media) with the final $OD_{600}$=0.2 for each vial were calculated, and a 10 ml cell suspension was prepared with anaerobic media and added into each vial. Each vial was capped and cells were then grown at 30° C. with shaking for three days. After three days of anaerobic growth, the cell density ($OD_{600}$) was then measured. Cells were centrifuged at 4,000 g for 5 min and the supernatant was collected for the isobutanol measurement using LC/MS.

LC/MS Analysis of Yeast Strains with K9 KARI Mutants

Samples were taken for LC/MS analysis at the end of the anaerobic growth period. LC/MS analysis was performed using a Waters AcQuity UPLC separations unit and AcQuity TQD triple quad mass spectrometer (Waters, Milford, Mass.) with a Waters AcQuity UPLC HSS T3 separations column (Waters, Milford, Mass.). Compounds were separated using a reverse phase gradient of water (+0.1% formic acid) and acetonitrile (+0.1% formic acid) starting with 99% aqueous and ending with 99% organic, at a flow rate of 0.5 mL/min. Chromatograms were analyzed using Waters Masslynx 4.1 software (Waters, Milford, Mass.). Micro molar yields for isobutanol were calculated using Waters Quanlynx software (Waters, Milford, Mass.) using a calibration curve of triplicate analyses of standards.

TABLE 31

Forward Primers

| Targeted position(s) of K9-KARI | | Primers |
|---|---|---|
| 169 | K9_169I_030812f | GCAAGGCTTTGGATATTGCTTTGGC (SEQ ID NO: 493) |
| | K9_169V_030812f | GCAAGGCTTTGGATGTTGCTTTGGC (SEQ ID NO: 494) |

TABLE 31-continued

Forward Primers

| Targeted position(s) of K9-KARI | Primers |
|---|---|
| K9_169R_050712f | GCAAGGCTTTGGATAGAGCTTTGGC (SEQ ID NO: 495) |
| K9_169T_050712f | GCAAGGCTTTGGATACTGCTTTGGC (SEQ ID NO: 496) |
| K9_169K_050712f | GCAAGGCTTTGGATAAGGCTTTGGC (SEQ ID NO: 497) |
| K9_169N_050712f | GCAAGGCTTTGGATAACGCTTTGGC (SEQ ID NO: 498) |
| K9_169A_050712f | GCAAGGCTTTGGATGCTGCTTTGGC (SEQ ID NO: 499) |
| K9_169D_050712f | GCAAGGCTTTGGATGATGCTTTGGC (SEQ ID NO: 500) |
| K9_169E_050712f | GCAAGGCTTTGGATGAAGCTTTGGC (SEQ ID NO: 501) |
| K9_169G_050712f | GCAAGGCTTTGGATGGTGCTTTGGC (SEQ ID NO: 502) |
| K9_169F_050712f | GCAAGGCTTTGGATTTTGCTTTGGC (SEQ ID NO: 503) |
| K9_169L_050712f | GCAAGGCTTTGGATTTGGCTTTGGC (SEQ ID NO: 504) |
| K9_169C_050712f | GCAAGGCTTTGGATTGTGCTTTGGC (SEQ ID NO: 505) |
| K9_169S_050712f | GCAAGGCTTTGGATTCTGCTTTGGC (SEQ ID NO: 506) |
| K9_169Y_050712f | GCAAGGCTTTGGATTATGCTTTGGC (SEQ ID NO: 507) |
| K9_169W_050712f | GCAAGGCTTTGGATTGGGCTTTGGC (SEQ ID NO: 508) |
| K9_169P_050712f | GCAAGGCTTTGGATCCAGCTTTGGC (SEQ ID NO: 509) |
| K9_169H_050712f | GCAAGGCTTTGGATCATGCTTTGGC (SEQ ID NO: 510) |
| K9_169Q_050712f | GCAAGGCTTTGGATCAAGCTTTGGC (SEQ ID NO: 511) |

TABLE 31

Isobutanol production of K9 variants in strain PNY2115

| Variant | Amino Acid Seq ID No: | Nucleic Acid SEQ ID NO: | Repeat | Isobutanol titer (mM) |
|---|---|---|---|---|
| EJF5 | 548 | 526 | 1 | 69.9 |
|  |  |  | 2 | 74.8 |
|  |  |  | 3 | 72.1 |
| EJA1 | 550 | 528 | 1 | 74.9 |
|  |  |  | 2 | 72.2 |
|  |  |  | 3 | 48.8 |
| EJB8 | 549 | 527 | 1 | 57.6 |
|  |  |  | 2 | 67.3 |
|  |  |  | 3 | 67.6 |
| EJB10 | 551 | 529 | 1 | 64.7 |
|  |  |  | 2 | 71.4 |
|  |  |  | 3 | 57.4 |
| K9SB2_SH | 94 | — | 1 | 62.6 |
|  |  |  | 2 | 57.4 |
|  |  |  | 3 | 32.5 |

Example 18

K9_Lucy_SH Variants

Additional variants based on K9_Lucy_SH, a truncated form of K9_Lucy lacking five N-terminal amino acids, were prepared and subcloned into the PmeI and SfiI sites of yeast expression plasmid pLH689 (SEQ ID NO: 306). Plasmids were transformed into strain PNY2115 and analyzed for isobutanol production as described in Example 5.

TABLE 32

Isobutanol Titers and Amino Acid Substitutions of Lucy_SH Variants

| K9_Lucy_SH Derivative | AA Seq ID No: | Mean Isobutanol (mM) | Amino Acid Substitutions |
|---|---|---|---|
| Control (K9_Lucy_SH) | 553 | 28 | Y53L, S56V, K57E, S58E, N87P |
| E147V | 552 | 24 | Y53L, S56V, K57E, S58E, N87P, E147V |
| G164D | 404 | 38 | Y53L, S56V, K57E, S58E, N87P, G164D |
| G304V | 405 | 19 | Y53L, S56V, K57E, S58E, N87P, G304V |
| N258S | 406 | 62 | Y53L, S56V, K57E, S58E, N87P, N258S |
| T71S | 407 | 11 | Y53L, S56V, K57E, S58E, N87P, T71S |
| V184I | 408 | 27 | Y53L, S56V, K57E, S58E, N87P, V184I |
| A279D | 409 | 31 | Y53L, S56V, K57E, S58E, N87P, A79D |
| D98V | 410 | 3 | Y53L, S56V, K57E, S58E, N87P, D98V |
| M169F | 411 | 16 | Y53L, S56V, K57E, S58E, N87P, M169F |
| M169K | 412 | 20 | Y53L, S56V, K57E, S58E, N87P, M169K |
| M169L | 413 | 32 | Y53L, S56V, K57E, S58E, N87P, M169L |
| E100Q M312K | 414 | 9 | Y53L, S56V, K57E, S58E, N87P, E100Q, M312K |

SEQUENCE LISTING (705 sequences)

SEQ ID NO: 1 - DNA, 4519 bp, Artificial Sequence
  pLA54
caccttggctaactcgttgtatcatcactggataacttcgtataatgtatgctatacgaagttatcgaacagagaaactaaatccacattaattgagagttctatctattagaaaatgcaaactccaactaaatgggaaaacagataacctcttttatttttttttaatgtttgatattcgagtctttttcttttgttaggtttatattcatcatttcaatgaataaaagaagcttcttattttggttgcaaagaatgaaaaaaaaggattttttcatacttctaaagcttcaattataaccaaaaattttataaatgaagagaaaaaatctagtagtatcaagttaaacttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatctcgagttttaatgttacttctcttgcagttagggaactataatgtaactcaaaataagattaaacaaactaaaataaaaagaagttatacagaaaaacccatataaaccagtactaatccataataataatacacaaaaaaactatcaaataaaaccagaaaacagattgaatagaaaaattttttcgatctccttttatattcaaaattcgatatatgaaaaagggaactctcagaaaatcaccaaatcaatttaattagatttttcttttccttctagcgttggaaagaaaaatttttctttttttttttagaaatgaaaaatttttgccgtaggaatcaccgtataaaccctgtataaacgctactctgttcacctgtgtaggctatgattgacccagtgttcattgttattgcgagagagcgggagaaaagaaccgatacaagagatccatgctggtatagttgtctgtccaacactttgatgaacttgtaggacgatgatgtgtatttagacgagtacgtgtgtgactattaagtagttatgatagagaggtttgtacggtgtgttctgtgtaattcgattgagaaaatggttatgaatccctagataacttcgtataatgtatgctatacgaagttatctgaacattagaatacgtaatccgcaatgcggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtac

SEQ ID NO: 2 - DNA, 80 bp, Artificial Sequence
  BK505
ttccggtttctttgaaatttttttgattcggtaatctccgagcagaaggagcattgcggattacgtattctaatgttcag

SEQ ID NO: 3 - DNA, 81 bp, Artificial Sequence
  BK506
gggtaataactgatataattaaattgaagctctaatttgtgagtttagtacaccttggctaactcgttgtatcatcactgg

SEQ ID NO: 4 - DNA, 38 bp, Artificial Sequence
  LA468
gcctcgagttttaatgttacttctcttgcagttaggga

SEQ ID NO: 5 - DNA, 31 bp, Artificial Sequence
  LA492
gctaaattcgagtgaaacacaggaagaccag

SEQ ID NO: 6 - DNA, 23 bp, Artificial Sequence
  AK109-1
agtcacatcaagatcgtttatgg

SEQ ID NO: 7 - DNA, 23 bp, Artificial Sequence
  AK109-2
gcacggaatatgggactacttcg

SEQ ID NO: 8 - DNA, 23 bp, Artificial Sequence
  AK109-3
actccacttcaagtaagagtttg

SEQ ID NO: 9 - DNA, 24 bp, Artificial Sequence
  oBP452
ttctcgacgtgggcctttttcttg

SEQ ID NO: 10 - DNA, 49 bp, Artificial Sequence
  oBP453
tgcagctttaaataatcggtgtcactactttgccttcgtttatcttgcc

SEQ ID NO: 11 - DNA, 49 bp, Artificial Sequence
  oBP454
gagcaggcaagataaacgaaggcaaagtagtgacaccgattatttaaag

SEQ ID NO: 12 - DNA, 49 bp, Artificial Sequence
  oBP455
tatggaccctgaaaccacagccacattgtaaccaccacgacggttgttg

SEQ ID NO: 13 - DNA, 49 bp, Artificial Sequence
  oBP456
tttagcaacaaccgtcgtggtggttacaatgtggctgtggtttcagggt

SEQ ID NO: 14 - DNA, 49 bp, Artificial Sequence
  oBP457
ccagaaaccctatacctgtgtggacgtaaggccatgaagctttttcttt

SEQ ID NO: 15 - DNA, 49 bp, Artificial Sequence
  oBP458
attggaaagaaaaagcttcatggccttacgtccacacaggtatagggtt

SEQ ID NO: 16 - DNA, 22 bp, Artificial Sequence
  oBP459
cataagaacacctttggtggag

SEQ ID NO: 17 - DNA, 22 bp, Artificial Sequence
  BP460
aggattatcattcataagtttc

SEQ ID NO: 18 - DNA, 20 bp, Artificial Sequence
  LA135
cttggcagcaacaggactag

SEQ ID NO: 19 - DNA, 23 bp, Artificial Sequence
  BP461
ttcttggagctgggacatgtttg

SEQ ID NO: 20 - DNA, 22 bp, Artificial Sequence
  LA92
gagaagatgcggccagcaaaac

SEQ ID NO: 21 - DNA, 4242 bp, Artificial Sequence
  pLA59
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccgcaatgcggatccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 22 - DNA, 80 bp, Artificial Sequence
  LA678
caacgttaacaccgttttcggtttgccaggtgacttcaacttgtccttgtgcattgcggattacgtattctaatgttcag

SEQ ID NO: 23 - DNA, 81 bp, Artificial Sequence
  LA679
gtggagcatcgaagactggcaacatgatttcaatcattctgatcttagagcaccttggctaactcgttgtatcatcactgg

SEQ ID NO: 24 - DNA, 23 bp, Artificial Sequence
  LA337
ctcatttgaatcagcttatggtg

SEQ ID NO: 25 - DNA, 24 bp, Artificial Sequence
  LA692
ggaagtcattgacaccatcttggc

SEQ ID NO: 26 - DNA, 24 bp, Artificial Sequence
  LA693
agaagctgggacagcagcgttagc

SEQ ID NO: 27 - DNA, 7523 bp, Artificial Sequence
  pLA34
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 28 - DNA, 96 bp, Artificial Sequence
  LA722
tgccaattatttacctaaacatctataaccttcaaaagtaaaaaaatacacaaacgttgaatcatcaccttggctaactcgttgtatcatcactgg

SEQ ID NO: 29 - DNA, 80 bp, Artificial Sequence
  LA733
cataatcaatctcaaagagaacaacacaatacaataacaagaagaacaaagcattgcggattacgtattctaatgttcag

SEQ ID NO: 30 - DNA, 30 bp, Artificial Sequence
  LA453
caccgaagaagaatgcaaaaatttcagctc

SEQ ID NO: 31 - DNA, 25 bp, Artificial Sequence
  LA694
gctgaagttgttagaactgttgttg

SEQ ID NO: 32 - DNA, 21 bp, Artificial Sequence
  LA695
tgttagctggagtagacttgg

SEQ ID NO: 33 - DNA, 22 bp, Artificial Sequence
  oBP594
agctgtctcgtgttgtgggttt

SEQ ID NO: 34 - DNA, 49 bp, Artificial Sequence
  oBP595
cttaataatagaacaatatcatcctttacgggcatcttatagtgtcgtt

SEQ ID NO: 35 - DNA, 49 bp, Artificial Sequence
  oBP596
gcgccaacgacactataagatgcccgtaaaggatgatattgttctatta

SEQ ID NO: 36 - DNA, 49 bp, Artificial Sequence
  oBP597
tatggaccctgaaaccacagccacattgcaacgacgacaatgccaaacc

SEQ ID NO: 37 - DNA, 49 bp, Artificial Sequence
  oBP598
tccttggtttggcattgtcgtcgttgcaatgtggctgtggtttcagggt

SEQ ID NO: 38 - DNA, 49 bp, Artificial Sequence
  oBP599
atcctctcgcggagtccctgttcagtaaaggccatgaagctttttcttt

SEQ ID NO: 39 - DNA, 49 bp, Artificial Sequence
  oBP600
attggaaagaaaaagcttcatggcctttactgaacagggactccgcgag

SEQ ID NO: 40 - DNA, 22 bp, Artificial Sequence
  oBP601
tcataccacaatcttagaccat

SEQ ID NO: 41 - DNA, 21 bp, Artificial Sequence
  oBP602
tgttcaaacccctaaccaacc

SEQ ID NO: 42 - DNA, 22 bp, Artificial Sequence
  oBP603
tgttcccacaatctattaccta

SEQ ID NO: 43 - DNA, 31 bp, Artificial Sequence
  LA811
aacgaagcatctgtgcttcattttgtagaac

SEQ ID NO: 44 - DNA, 59 bp, Artificial Sequence
  LA817
cgatccacttgtatatttggatgaatttttgaggaattctgaaccagtcctaaaacgag

SEQ ID NO: 45 - DNA, 31 bp, Artificial Sequence
  LA812
aacaaagatatgctattgaagtgcaagatgg

SEQ ID NO: 46 - DNA, 33 bp, Artificial Sequence
  LA818
ctcaaaaattcatccaaatatacaagtggatcg

SEQ ID NO: 47 - DNA, 90 bp, Artificial Sequence
  LA512
gtattttggtagattcaattctctttccctttccttttccttcgctccccttccttatcagcattgcggattacgtattctaatgttcag

SEQ ID NO: 48 - DNA, 90 bp, Artificial Sequence
  LA513
ttggttgggggaaaaagaggcaacaggaaagatcagagggggagggggggggagagtgtcaccttggctaactcgttgtatcatcactgg

SEQ ID NO: 49 - DNA, 29 bp, Artificial Sequence
  LA516
ctcgaaacaataagacgacgatggctctg

SEQ ID NO: 50 - DNA, 30 bp, Artificial Sequence
  LA514
cactatctggtgcaaacttggcaccggaag

SEQ ID NO: 51 - DNA, 29 bp, Artificial Sequence
  LA515
tgtttgtagccactcgtgaacttctctgc

SEQ ID NO: 52 - DNA, 6903 bp, Artificial Sequence
  pLA71
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcgatctgaaatgaataacaatactgacagtagatctgaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaatctagagctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttaggttttgggacgctcgaaggctttaatttggatccgcattgcggattacgtattctaatgttcagtaccgttcgtataatgtatgctatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 53 - DNA, 96 bp, Artificial Sequence
  LA829
ccaaatttacaatatctcctgaattcttggcttggaatatgggcagtacagcttgtgtgatattgcaccttggctaactcgttgtatcatcactgg

SEQ ID NO: 54 - DNA, 90 bp, Artificial Sequence
  LA834
atgtcccaaggtagaaaagctgcagaaagattggctaagaagactgtcctcattacaggtgatctgaaatgaataacaatactgacagta

SEQ ID NO: 55 - DNA, 29 bp, Artificial Sequence
  N1257
gatgatgctatttggtgcagagggtgatg

SEQ ID NO: 56 - DNA, 29 bp, Artificial Sequence
  LA830
cacggcaaacttagaggcacaatagatag

SEQ ID NO: 57 - DNA, 6924 bp, Artificial Sequence
  pLA78
gatccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttccaattaccgtcgctcgtgatttgtttgcaaaaagaacaaaactgaaaaaacccagacacgctcgacttcctgtcttcctattgattgcagcttccaatttcgtcacacaacaaggtcctgtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaagtttaaacatgtataccgtaggacagtacttggtagatagactagaagagattggtatcgataaggttttcggtgtgccaggggattacaatttgacttttctagattacattcaaaatcacgaaggactttcctggcaagggaatactaatgaactaaacgcagcatatgcagcagatggctacgcccgtgaaagaggcgtatcagctcttgttactacattcggagtgggtgaactgtcagccattaacggaacagctggtagttttgcagaacaagtccctgtcatccacatcgtgggttctccaactatgaatgtgcaatccaacaaaaagctggttcatcattccttaggaatgggtaactttcataactttagtgaaatggctaaggaagtcactgccgctacaaccatgcttactgaagagaatgcagcttcagagatcgacagagtattagaaacagccttgttggaaaagaggccagtatacatcaatcttccaattgatatagctcataaagcaatagttaaacctgcaaaagcactacaaacagagaaatcatctggtgagagagaggcacaacttgcagaaatcatactatcacacttagaaaaggccgctcaacctatcgtaatcgccggtcatgagatcgcccgtttccagataagagaaagatttgaaaactggataaaccaaacaaagttgccagtaaccaatttggcatatggcaaaggctctttcaatgaagagaacgaacatttcattggtacctattacccagctttttctgacaaaaacgttctggattacgttgacaatagtgacttcgttttacattttggtgggaaaatcattgacaattctacctcctcattttctcaaggctttaagactgaaaacactttaaccgctgcaaatgacatcattatgctgccagatgggtctacttactctgggatttctcttaacggtcttttggcagagctggaaaaactaaactttacttttgctgatactgctgctaaacaagctgaattagctgttttcgaaccacaggccgaaacaccactaaagcaagacagatttcaccaagctgttatgaactttttgcaagctgatgatgtgttggtcactgagcaggggacatcatctttcggtttgatgttggcacctctgaaaaagggtatgaatttgatcagtcaaacattatggggctccataggatacacattacctgctatgattggttcacaaattgctgccccagaaaggagacacattctatccatcggtgatggatcttttcaactgacagcacaggaaatgtccaccatcttcagagagaaattgacaccagtgatattcattatcaataacgatggctatacagtcgaaagagccatccatggagaggatgagagttacaatgatataccaacttggaacttgcaattagttgctgaaacatttggtggtgatgccgaaactgtcgacactcacaacgttttcacagaaacagacttcgctaatactttagctgctatcgatgctactcctcaaaaagcacatgtcgttgaagttcatatggaacaaatggatatgccagaatcattgagacagattggcttagccttatctaagcaaaactcttaagtttaaactaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgttgtaatcgttcttccacacg

SEQ ID NO: 58 - DNA, 92 bp, Artificial Sequence
  LA850
atgactaagctacactttgacactgctgaaccagtcaagatcacacttccaaatggtttgacataaattaccgtcgctcgtgatttgtttgc

SEQ ID NO: 59 - DNA, 94 bp, Artificial Sequence
  LA851
ttacaacttaattctgacagcttttacttcagtgtatgcatggtagacttcttcacccatttccaccttggctaactcgttgtatcatcactgg

SEQ ID NO: 60 - DNA, 24 bp, Artificial Sequence
  N1262
cacgtaagggcatgatagaattgg

SEQ ID NO: 61 - DNA, 22 bp, Artificial Sequence
  LA740
cgataatcctgctgtcattatc

SEQ ID NO: 62 - DNA, 26 bp, Artificial Sequence
  N1263
ggatatagcagttgttgtacactagc

SEQ ID NO: 63 - DNA, 6761 bp, Artificial Sequence
  pLA65
gatccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttatgaaagcattagtgtataggggcccaggccagaagttggtggaagagagacagaagccagagcttaaggaacctggtgacgctatagtgaaggtaacaaagactacaatttgcggaaccgatctacacattcttaaaggtgacgttgcgacttgtaaacccggtcgtgtattagggcatgaaggagtgggggttattgaatcagtcggatctggggttactgctttccaaccaggcgatagagttttgatatcatgtatatcgagttgcggaaagtgctcattttgtagaagaggaatgttcagtcactgtacgaccgggggttggattctgggcaacgaaattgatggtacccaagcagagtacgtaagagtaccacatgctgacacatccctttatcgtattccggcaggtgcggatgaagaggccttagtcatgttatcagatattctaccaacgggttttgagtgcggagtcctaaacggcaaagtcgcacctggttcttcggtggctatagtaggtgctggtcccgttggtttggccgccttactgacagcacaattctactccccagctgaaatcataatgatcgatcttgatgataacaggctgggattagccaaacaatttggtgccaccagaacagtaaactccacgggtggtaacgccgcagccgaagtgaaagctcttactgaaggcttaggtgttgatactgcgattgaagcagttgggatacctgctacatttgaattgtgtcagaatatcgtagctcccggtggaactatcgctaatgtcggcgttcacggtagcaaagttgatttgcatcttgaaagtttatggtcccataatgtcacgattactacaaggttggttgacacggctaccaccccgatgttactgaaaactgttcaaagtcacaagctagatccatctagattgataacacatagattcagcctggaccagatcttggacgcatatgaaacttttggccaagctgcgtctactcaagcactaaaagtcatcatttcgatggaggcttgattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtg

SEQ ID NO: 64 - DNA, 80 bp, Artificial Sequence
  LA855
gcacaatatttcaagctataccaagcatacaatcaactatctcatatacaacctggtaaaacctctagtggagtagtaga

SEQ ID NO: 65 - DNA, 83 bp, Artificial Sequence
  LA856
gcttatttagaagtgtcaacaacgtatctaccaacgatttgacccttttccacaccttggctaactcgttgtatcatcactgg

SEQ ID NO: 66 - DNA, 25 bp, Artificial Sequence
  LA414
ccagagctgatgaggggtatctcga

SEQ ID NO: 67 - DNA, 25 bp, Artificial Sequence
  LA749
caagtcttttgtgccttcccgtcgg

SEQ ID NO: 68 - DNA, 25 bp, Artificial Sequence
  LA413
ggacataaaatacacaccgagattc

SEQ ID NO: 69 - DNA, 90 bp, Artificial Sequence
  LA860
tctcaattattattttctactcataacctcacgcaaaataacacagtcaaatcaatcaaaatgaaagcattagtgtataggggcccaggc

SEQ ID NO: 70 - DNA, 26 bp, Artificial Sequence
  N1093
tttcaagatgcaaatcaactttgcta

SEQ ID NO: 71 - DNA, 20 bp, Artificial Sequence
  LA681
ttattgcttagcgttggtag

SEQ ID NO: 72 - DNA, 90 bp, Artificial sequence
  Prime895
tctcaattattattttctactcataacctcacgcaaaataacacagtcaaatcaatcaaaatgttgacaaaagcaacaaaagaacaaaaa

SEQ ID NO: 73 - DNA, 81 bp, Artificial sequence; identical to SEQ ID NO: 23
  Primer679

SEQ ID NO: 74 - DNA, 20 bp, Artificial sequence
  Primer681
ttattgcttagcgttggtag

SEQ ID NO: 75 - DNA, 22 bp, Artificial sequence
  Primer92
gagaagatgcggccagcaaaac

SEQ ID NO: 76 - DNA, 25 bp, Artificial sequence
  N245
agggtagcctccccataacataaac

SEQ ID NO: 77 - DNA, 25 bp, Artificial sequence
  N246
tctccaaatatatacctcttgtgtg

SEQ ID NO: 78 - DNA, 90 bp, Artificial sequence
  Primer896
ttttatatacagtataaataaaaaacccacgtaatatagcaaaaacatattgccaacaaaaattaccgtcgctcgtgatttgtttgcaaa

SEQ ID NO: 79 - DNA, 90 bp, Artificial sequence
  Primer897
caaactgtgtaagtttatttatttgcaacaataattcgtttgagtacactactaatggccaccttggctaactcgttgtatcatcactgg

SEQ ID NO: 80 - DNA, 28 bp, Artificial sequence
  Primer365
ctctatctccgctcaggctaagcaattg

SEQ ID NO: 81 - DNA, 26 bp, Artificial sequence
  Primer366
cagccgactcaacggcctgtttcacg

SEQ ID NO: 82 - DNA, 28 bp, Artificial sequence
  N638
aaaagatagtgtagtagtgataaactgg

SEQ ID NO: 83 - DNA, 22 bp, Artificial sequence
  Primer740
cgataatcctgctgtcattatc

SEQ ID NO: 84 - DNA, 83 bp, Artificial sequence; identical to SEQ ID NO: 65
  Primer856

SEQ ID NO: 85 - DNA, 80 bp, Artificial sequence
  Primer857
gcacaatatttcaagctataccaagcatacaatcaactatctcatatacaatgaaagcattagtgtataggggcccaggc

SEQ ID NO: 86 - DNA, 25 bp, Artificial sequence
  BK 415
gcctcattgatggtggtacataacg

SEQ ID NO: 87 - DNA, 26 bp, Artificial sequence
  N1092
agagttttgatatcatgtatatcgag

SEQ ID NO: 88 - DNA, 25 bp, Artificial sequence
  Primer413
ggacataaaatacacaccgagattc

SEQ ID NO: 89 - DNA, 92 bp, Artificial sequence
  Primer906
atgacaggtgaaagaattgaaaaggtgaaaataaatgacgaatttgcaaaatcacatttcacctggtaaaacctctagtggagtagtagatg

SEQ ID NO: 90 - DNA, 87 bp, Artificial sequence
  Primer907
aaaaagattcaatgccgtctcctttcgaaacttaataatagaacaatatcatccttcaccttggctaactcgttgtatcatcactgg

SEQ ID NO: 91 - DNA, 70 bp, Artificial sequence
  Primer667
tctcctttcgaaacttaataatagaacaatatcatccttttgtaaaacgacggccagtgaattcaccttg

SEQ ID NO: 92 - DNA, 25 bp, Artificial sequence
  Primer749
caagtcttttgtgccttcccgtcgg

SEQ ID NO: 93 - protein, 343 aa, Anaerostipes caccae
MEECKMAKIYYQEDCNLSLLDGKTIAVIGYGSQGHAHALNAKESGCNVIIGLYEGSKSWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 94 - protein, 338 aa, Artificial sequence
  K9SB2_SH
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 95 - DNA, 12304 bp, Artificial sequence
  K9SB2_SH_DHAD
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 96 - DNA, 21 bp, Artificial sequence
  SB2_r1
tggaccggtaatgtagtcacc

SEQ ID NO: 97 - DNA, 35 bp, Artificial sequence
  SB2_K90
cccagatgaaaagcaggctaccatgtacaaaaacg

SEQ ID NO: 98 - DNA, 35 bp, Artificial sequence
  SB2_K90M_f
cccagatgaaatgcaggctaccatgtacaaaaacg

SEQ ID NO: 99 - DNA, 35 bp, Artificial sequence
  SB2_K90L_f
cccagatgaattgcaggctaccatgtacaaaaacg

SEQ ID NO: 100 - DNA, 35 bp, Artificial sequence
  SB2_K90Y_f
cccagatgaataccaggctaccatgtacaaaaacg

SEQ ID NO: 101 - DNA, 35 bp, Artificial sequence
  SB2_K90A_f
cccagatgaagctcaggctaccatgtacaaaaacg

SEQ ID NO: 102 - DNA, 32 bp, Artificial sequence
  SB2_T93
caggctaccatgtacaaaaacgacatcgaacc

SEQ ID NO: 103 - DNA, 32 bp, Artificial sequence
  SB2_T93I_f
caggctatcatgtacaaaaacgacatcgaacc

SEQ ID NO: 104 - DNA, 32 bp, Artificial sequence
  SB2_T93A_f
caggctgctatgtacaaaaacgacatcgaacc

SEQ ID NO: 105 - DNA, 32 bp, Artificial sequence
  SB2_T93L_f
caggctttgatgtacaaaaacgacatcgaacc

SEQ ID NO: 106 - DNA, 32 bp, Artificial sequence
  SB2_T93V_f
caggctgttatgtacaaaaacgacatcgaacc

SEQ ID NO: 107 - DNA, 22 bp, Artificial sequence
  pHR81-F
acacccagtattttccctttcc

SEQ ID NO: 108 - DNA, 22 bp, Artificial sequence
  pBAD-Rev
ctagtgtacagatgtatgtcgg

SEQ ID NO: 109 - protein, 338 aa, Artificial sequence
  K9YW2
MAKIYYQEDCNLSLLDGKTIAVIGYGSQGHAHALNAKESGCNVIIGLFEGAEEWKRAEEQGFEVYTAAEAAKKADIIMILIPDEKQAIMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 110 - protein, 338 aa, Artificial sequence
  K9YW3
MAKIYYQEDCNLSLLDGKTIAVIGYGSQGHAHALNAKESGCNVIIGLFEGAEEWKRAEEQGFEVYTAAEAAKKADIIMILIPDEKQAAMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 111 - protein, 338 aa, Artificial sequence
  K9YW4
MAKIYYQEDCNLSLLDGKTIAVIGYGSQGHAHALNAKESGCNVIIGLFEGAEEWKRAEEQGFEVYTAAEAAKKADIIMILIPDEKQAVMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 112 - protein, 338 aa, Artificial sequence
  K9YW5
MAKIYYQEDCNLSLLDGKTIAVIGYGSQGHAHALNAKESGCNVIIGLFEGAEEWKRAEEQGFEVYTAAEAAKKADIIMILIPDEKQALMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 113 - protein, 338 aa, Artificial sequence
  K9YW6
MAKIYYQEDCNLSLLDGKTIAVIGYGSQGHAHALNAKESGCNVIIGLFEGAEEWKRAEEQGFEVYTAAEAAKKADIIMILIPDEMQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 114 - protein, 338 aa, Artificial sequence
  K9YW7
MAKIYYQEDCNLSLLDGKTIAVIGYGSQGHAHALNAKESGCNVIIGLFEGAEEWKRAEEQGFEVYTAAEAAKKADIIMILIPDEMQAIMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 115 - protein, 338 aa, Artificial sequence
  K9YW8
MAKIYYQEDCNLSLLDGKTIAVIGYGSQGHAHALNAKESGCNVIIGLFEGAEEWKRAEEQGFEVYTAAEAAKKADIIMILIPDEMQAAMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 116 - protein, 338 aa, Artificial sequence
  K9YW9
MAKIYYQEDCNLSLLDGKTIAVIGYGSQGHAHALNAKESGCNVIIGLFEGAEEWKRAEEQGFEVYTAAEAAKKADIIMILIPDEMQAVMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 117 - protein, 338 aa, Artificial sequence
  K9YW10
MAKIYYQEDCNLSLLDGKTIAVIGYGSQGHAHALNAKESGCNVIIGLFEGAEEWKRAEEQGFEVYTAAEAAKKADIIMILIPDEMQALMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 118 - protein, 338 aa, Artificial sequence
  K9YW11
MAKIYYQEDCNLSLLDGKTIAVIGYGSQGHAHALNAKESGCNVIIGLFEGAEEWKRAEEQGFEVYTAAEAAKKADIIMILIPDELQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 119 - protein, 338 aa, Artificial sequence
  K9YW12
MAKIYYQEDCNLSLLDGKTIAVIGYGSQGHAHALNAKESGCNVIIGLFEGAEEWKRAEEQGFEVYTAAEAAKKADIIMILIPDELQAIMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 120 - protein, 338 aa, Artificial sequence
  K9YW13
MAKIYYQEDCNLSLLDGKTIAVIGYGSQGHAHALNAKESGCNVIIGLFEGAEEWKRAEEQGFEVYTAAEAAKKADIIMILIPDELQAAMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 121 - protein, 338 aa, Artificial sequence
  K9YW14
MAKIYYQEDCNLSLLDGKTIAVIGYGSQGHAHALNAKESGCNVIIGLFEGAEEWKRAEEQGFEVYTAAEAAKKADIIMILIPDELQAVMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 122 - protein, 338 aa, Artificial sequence
  K9YW15
MAKIYYQEDCNLSLLDGKTIAVIGYGSQGHAHALNAKESGCNVIIGLFEGAEEWKRAEEQGFEVYTAAEAAKKADIIMILIPDELQALMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 123 - protein, 338 aa, Artificial sequence
  K9YW16
MAKIYYQEDCNLSLLDGKTIAVIGYGSQGHAHALNAKESGCNVIIGLFEGAEEWKRAEEQGFEVYTAAEAAKKADIIMILIPDEYQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 124 - protein, 338 aa, Artificial sequence
  K9YW17
MAKIYYQEDCNLSLLDGKTIAVIGYGSQGHAHALNAKESGCNVIIGLFEGAEEWKRAEEQGFEVYTAAEAAKKADIIMILIPDEYQAIMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 125 - protein, 338 aa, Artificial sequence
  K9YW18
MAKIYYQEDCNLSLLDGKTIAVIGYGSQGHAHALNAKESGCNVIIGLFEGAEEWKRAEEQGFEVYTAAEAAKKADIIMILIPDEYQAAMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 126 - protein, 338 aa, Artificial sequence
  K9YW19
MAKIYYQEDCNLSLLDGKTIAVIGYGSQGHAHALNAKESGCNVIIGLFEGAEEWKRAEEQGFEVYTAAEAAKKADIIMILIPDEYQAVMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 127 - protein, 338 aa, Artificial sequence
  K9YW20
MAKIYYQEDCNLSLLDGKTIAVIGYGSQGHAHALNAKESGCNVIIGLFEGAEEWKRAEEQGFEVYTAAEAAKKADIIMILIPDEYQALMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 128 - protein, 338 aa, Artificial sequence
  K9YW21
MAKIYYQEDCNLSLLDGKTIAVIGYGSQGHAHALNAKESGCNVIIGLFEGAEEWKRAEEQGFEVYTAAEAAKKADIIMILIPDEAQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 129 - protein, 338 aa, Artificial sequence
  K9YW22
MAKIYYQEDCNLSLLDGKTIAVIGYGSQGHAHALNAKESGCNVIIGLFEGAEEWKRAEEQGFEVYTAAEAAKKADIIMILIPDEAQAIMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 130 - protein, 338 aa, Artificial sequence
  K9YW23
MAKIYYQEDCNLSLLDGKTIAVIGYGSQGHAHALNAKESGCNVIIGLFEGAEEWKRAEEQGFEVYTAAEAAKKADIIMILIPDEAQAAMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 131 - protein, 338 aa, Artificial sequence
  K9YW24
MAKIYYQEDCNLSLLDGKTIAVIGYGSQGHAHALNAKESGCNVIIGLFEGAEEWKRAEEQGFEVYTAAEAAKKADIIMILIPDEAQAVMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 132 - protein, 338 aa, Artificial sequence
  K9YW25
MAKIYYQEDCNLSLLDGKTIAVIGYGSQGHAHALNAKESGCNVIIGLFEGAEEWKRAEEQGFEVYTAAEAAKKADIIMILIPDEAQALMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 133 - DNA, 40 bp, Artificial sequence
  Primer 1
ccagatgaaaagcaggctaccttgtacaaaaacgacatcg

SEQ ID NO: 134 - DNA, 40 bp, Artificial sequence
  Primer 2
ccagatgaaaagcaggctatcatgtacaaaaacgacatcg

SEQ ID NO: 135 - DNA, 40 bp, Artificial sequence
  Primer 3
ccagatgaaaagcaggctatcatctacaaaaacgacatcg

SEQ ID NO: 136 - DNA, 40 bp, Artificial sequence
  Primer 4
ccagatgaaaagcaggctatcttgtacaaaaacgacatcg

SEQ ID NO: 137 - DNA, 40 bp, Artificial sequence
  Primer 5
ccagatgaaaagcaggctgccatctacaaaaacgacatcg

SEQ ID NO: 138 - DNA, 40 bp, Artificial sequence
  Primer 6
ccagatgaaaagcaggctgccttgtacaaaaacgacatcg

SEQ ID NO: 139 - DNA, 40 bp, Artificial sequence
  Primer 7
ccagatgaaaagcaggctgtcatgtacaaaaacgacatcg

SEQ ID NO: 140 - DNA, 40 bp, Artificial sequence
  Primer 8
ccagatgaaatgcaggctaccatctacaaaaacgacatcg

SEQ ID NO: 141 - DNA, 40 bp, Artificial sequence
  Primer 9
ccagatgaaatgcaggctaccttgtacaaaaacgacatcg

SEQ ID NO: 142 - DNA, 40 bp, Artificial sequence
  Primer 10
ccagatgaaatgcaggctatcatgtacaaaaacgacatcg

SEQ ID NO: 143 - DNA, 40 bp, Artificial sequence
  Primer 11
ccagatgaataccaggctaccatgtacaaaaacgacatcg

SEQ ID NO: 144 - DNA, 40 bp, Artificial sequence
  Primer 12
ccagatgaaatgcaggctgccatgtacaaaaacgacatcg

SEQ ID NO: 145 - DNA, 40 bp, Artificial sequence
  Primer 13
ccagatgaaaagcaggctaccttctacaaaaacgacatcg

SEQ ID NO: 146 - DNA, 40 bp, Artificial sequence
  Primer 14
ccagatgaaaagcaggctgtcatctacaaaaacgacatcg

SEQ ID NO: 147 - DNA, 40 bp, Artificial sequence
  Primer 15
ccagatgaaaagcaggctgtcttgtacaaaaacgacatcg

SEQ ID NO: 148 - DNA, 40 bp, Artificial sequence
  Primer 16
ccagatgaaatgcaggctatcatctacaaaaacgacatcg

SEQ ID NO: 149 - DNA, 40 bp, Artificial sequence
  Primer 17
ccagatgaaatgcaggctatcttgtacaaaaacgacatcg

SEQ ID NO: 150 - DNA, 40 bp, Artificial sequence
  Primer 18
ccagatgaattgcaggctaccatctacaaaaacgacatcg

SEQ ID NO: 151 - DNA, 40 bp, Artificial sequence
  Primer 19
ccagatgaattgcaggctaccttgtacaaaaacgacatcg

SEQ ID NO: 152 - DNA, 40 bp, Artificial sequence
  Primer 20
ccagatgaattgcaggctatcatgtacaaaaacgacatcg

SEQ ID NO: 153 - DNA, 40 bp, Artificial sequence
  Primer 21
ccagatgaattgcaggctgccatgtacaaaaacgacatcg

SEQ ID NO: 154 - DNA, 40 bp, Artificial sequence
  Primer 22
ccagatgaataccaggctgccatgtacaaaaacgacatcg

SEQ ID NO: 155 - DNA, 40 bp, Artificial sequence
  Primer 23
ccagatgaataccaggctaccatctacaaaaacgacatcg

SEQ ID NO: 156 - DNA, 40 bp, Artificial sequence
  Primer 24
ccagatgaataccaggctaccttgtacaaaaacgacatcg

SEQ ID NO: 157 - DNA, 40 bp, Artificial sequence
  Primer 25
ccagatgaataccaggctatcatgtacaaaaacgacatcg

SEQ ID NO: 158 - DNA, 40 bp, Artificial sequence
  Primer 26
ccagatgaaatgcaggctgccatctacaaaaacgacatcg

SEQ ID NO: 159 - DNA, 40 bp, Artificial sequence
  Primer 27
ccagatgaaatgcaggctgccttgtacaaaaacgacatcg

SEQ ID NO: 160 - DNA, 40 bp, Artificial sequence
  Primer 28
ccagatgaaatgcaggctgtcatgtacaaaaacgacatcg

SEQ ID NO: 161 - DNA, 40 bp, Artificial sequence
  Primer 29
ccagatgaaaagcaggctatcttctacaaaaacgacatcg

SEQ ID NO: 162 - DNA, 40 bp, Artificial sequence
  Primer 30
ccagatgaaaagcaggctgccttctacaaaaacgacatcg

SEQ ID NO: 163 - DNA, 40 bp, Artificial sequence
  Primer 31
ccagatgaaatgcaggctaccttctacaaaaacgacatcg

SEQ ID NO: 164 - DNA, 40 bp, Artificial sequence
  Primer 32
ccagatgaattgcaggctatcatctacaaaaacgacatcg

SEQ ID NO: 165 - DNA, 40 bp, Artificial sequence
  Primer 33
ccagatgaattgcaggctatcttgtacaaaaacgacatcg

SEQ ID NO: 166 - DNA, 40 bp, Artificial sequence
  Primer 34
ccagatgaattgcaggctgccatctacaaaaacgacatcg

SEQ ID NO: 167 - DNA, 40 bp, Artificial sequence
  Primer 35
ccagatgaattgcaggctgccttgtacaaaaacgacatcg

SEQ ID NO: 168 - DNA, 40 bp, Artificial sequence
  Primer 36
ccagatgaataccaggctgccatctacaaaaacgacatcg

SEQ ID NO: 169 - DNA, 40 bp, Artificial sequence
  Primer 37
ccagatgaataccaggctgccttgtacaaaaacgacatcg

SEQ ID NO: 170 - DNA, 40 bp, Artificial sequence
  Primer 38
ccagatgaattgcaggctgtcatgtacaaaaacgacatcg

SEQ ID NO: 171 - DNA, 40 bp, Artificial sequence
  Primer 39
ccagatgaataccaggctatcatctacaaaaacgacatcg

SEQ ID NO: 172 - DNA, 40 bp, Artificial sequence
  Primer 40
ccagatgaataccaggctatcttgtacaaaaacgacatcg

SEQ ID NO: 173 - DNA, 40 bp, Artificial sequence
  Primer 41
ccagatgaataccaggctgtcatgtacaaaaacgacatcg

SEQ ID NO: 174 - DNA, 40 bp, Artificial sequence
  Primer 42
ccagatgaaatgcaggctgtcatctacaaaaacgacatcg

SEQ ID NO: 175 - DNA, 40 bp, Artificial sequence
  Primer 43
ccagatgaaatgcaggctgtcttgtacaaaaacgacatcg

SEQ ID NO: 176 - DNA, 40 bp, Artificial sequence
  Primer 44
ccagatgaaatgcaggctatcttctacaaaaacgacatcg

SEQ ID NO: 177 - DNA, 40 bp, Artificial sequence
  Primer 45
ccagatgaaatgcaggctgccttctacaaaaacgacatcg

SEQ ID NO: 178 - DNA, 40 bp, Artificial sequence
  Primer 46
ccagatgaaaagcaggctgtcttctacaaaaacgacatcg

SEQ ID NO: 179 - DNA, 40 bp, Artificial sequence
  Primer 47
ccagatgaattgcaggctaccttctacaaaaacgacatcg

SEQ ID NO: 180 - DNA, 40 bp, Artificial sequence
  Primer 48
ccagatgaataccaggctaccttctacaaaaacgacatcg

SEQ ID NO: 181 - DNA, 40 bp, Artificial sequence
  Primer 49
ccagatgaattgcaggctgtcatctacaaaaacgacatcg

SEQ ID NO: 182 - DNA, 40 bp, Artificial sequence
  Primer 50
ccagatgaattgcaggctgtcttgtacaaaaacgacatcg

SEQ ID NO: 183 - DNA, 40 bp, Artificial sequence
  Primer 51
ccagatgaataccaggctgtcatctacaaaaacgacatcg

SEQ ID NO: 184 - DNA, 40 bp, Artificial sequence
  Primer 52
ccagatgaataccaggctgtcttgtacaaaaacgacatcg

SEQ ID NO: 185 - DNA, 40 bp, Artificial sequence
  Primer 53
ccagatgaattgcaggctatcttctacaaaaacgacatcg

SEQ ID NO: 186 - DNA, 40 bp, Artificial sequence
  Primer 54
ccagatgaattgcaggctgccttctacaaaaacgacatcg

SEQ ID NO: 187 - DNA, 40 bp, Artificial sequence
  Primer 55
ccagatgaataccaggctgccttctacaaaaacgacatcg

SEQ ID NO: 188 - DNA, 40 bp, Artificial sequence
  Primer 56
ccagatgaataccaggctatcttctacaaaaacgacatcg

SEQ ID NO: 189 - DNA, 40 bp, Artificial sequence
  Primer 57
ccagatgaattgcaggctgtcttctacaaaaacgacatcg

SEQ ID NO: 190 - DNA, 40 bp, Artificial sequence
  Primer 58
ccagatgaataccaggctgtcttctacaaaaacgacatcg

SEQ ID NO: 191 - DNA, 41 bp, Artificial sequence
  Reverse Primer
gctgaaaacacaccttgtaatatccacttacatgactttgg

SEQ ID NO: 192 - protein, 338 aa, Artificial sequence
  K9JM1
MAKIYYQEDCNLSLLDGKTIAVIGYGSQGHAHALNAKESGCNVIIGLFEGAEEWKRAEEQGFEVYTAAEAAKKADIIMILIPDELQAALYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 193 - protein, 338 aa, Artificial sequence
  K9JM2
MAKIYYQEDCNLSLLDGKTIAVIGYGSQGHAHALNAKESGCNVIIGLFEGAEEWKRAEEQGFEVYTAAEAAKKADIIMILIPDELQATLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 194 - protein, 338 aa, Artificial sequence; identical to SEQ ID NO: 123
  K9JM3

SEQ ID NO: 195 - protein, 338 aa, Artificial sequence
  K9JM4
MAKIYYQEDCNLSLLDGKTIAVIGYGSQGHAHALNAKESGCNVIIGLFEGAEEWKRAEEQGFEVYTAAEAAKKADIIMILIPDEMQAALYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 196 - protein, 338 aa, Artificial sequence
  K9JM5
MAKIYYQEDCNLSLLDGKTIAVIGYGSQGHAHALNAKESGCNVIIGLFEGAEEWKRAEEQGFEVYTAAEAAKKADIIMILIPDEMQAAIYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 197 - protein, 338 aa, Artificial sequence
  K9JM6
MAKIYYQEDCNLSLLDGKTIAVIGYGSQGHAHALNAKESGCNVIIGLFEGAEEWKRAEEQGFEVYTAAEAAKKADIIMILIPDEMQATIYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 198 - protein, 338 aa, Artificial sequence
  K9JM7
MAKIYYQEDCNLSLLDGKTIAVIGYGSQGHAHALNAKESGCNVIIGLFEGAEEWKRAEEQGFEVYTAAEAAKKADIIMILIPDEKQAVIYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 199 - protein, 338 aa, Artificial sequence
  K9JM8
MAKIYYQEDCNLSLLDGKTIAVIGYGSQGHAHALNAKESGCNVIIGLFEGAEEWKRAEEQGFEVYTAAEAAKKADIIMILIPDEKQAAIYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 200 - protein, 338 aa, Artificial sequence
  K9JM9
MAKIYYQEDCNLSLLDGKTIAVIGYGSQGHAHALNAKESGCNVIIGLFEGAEEWKRAEEQGFEVYTAAEAAKKADIIMILIPDEYQAAFYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 201 - protein, 338 aa, Artificial sequence
  K9JM10
MAKIYYQEDCNLSLLDGKTIAVIGYGSQGHAHALNAKESGCNVIIGLFEGAEEWKRAEEQGFEVYTAAEAAKKADIIMILIPDEYQATIYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 202 - protein, 338 aa, Artificial sequence
  K9JM11
MAKIYYQEDCNLSLLDGKTIAVIGYGSQGHAHALNAKESGCNVIIGLFEGAEEWKRAEEQGFEVYTAAEAAKKADIIMILIPDEYQATLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 203 - protein, 338 aa, Artificial sequence
  K9JM12
MAKIYYQEDCNLSLLDGKTIAVIGYGSQGHAHALNAKESGCNVIIGLFEGAEEWKRAEEQGFEVYTAAEAAKKADIIMILIPDEMQAILYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 204 - protein, 338 aa, Artificial sequence
  K9JM13
MAKIYYQEDCNLSLLDGKTIAVIGYGSQGHAHALNAKESGCNVIIGLFEGAEEWKRAEEQGFEVYTAAEAAKKADIIMILIPDELQAVLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 205 - protein, 338 aa, Artificial sequence; identical to SEQ ID NO: 109
  K9JM14

SEQ ID NO: 206 - protein, 338 aa, Artificial sequence
  K9JM15
MAKIYYQEDCNLSLLDGKTIAVIGYGSQGHAHALNAKESGCNVIIGLFEGAEEWKRAEEQGFEVYTAAEAAKKADIIMILIPDEKQAIFYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 207 - protein, 338 aa, Artificial sequence
  K9JM16
MAKIYYQEDCNLSLLDGKTIAVIGYGSQGHAHALNAKESGCNVIIGLFEGAEEWKRAEEQGFEVYTAAEAAKKADIIMILIPDEKQAILYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 208 - protein, 338 aa, Artificial sequence
  K9JM17
MAKIYYQEDCNLSLLDGKTIAVIGYGSQGHAHALNAKESGCNVIIGLFEGAEEWKRAEEQGFEVYTAAEAAKKADIIMILIPDELQAIIYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 209 - protein, 338 aa, Artificial sequence; identical to SEQ ID NO: 115
  K9JM18

SEQ ID NO: 210 - protein, 338 aa, Artificial sequence; identical to SEQ ID NO: 114
  K9JM19

SEQ ID NO: 211 - protein, 338 aa, Artificial sequence
  K9JM20
MAKIYYQEDCNLSLLDGKTIAVIGYGSQGHAHALNAKESGCNVIIGLFEGAEEWKRAEEQGFEVYTAAEAAKKADIIMILIPDEMQATLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 212 - protein, 338 aa, Artificial sequence
  K9JM21
MAKIYYQEDCNLSLLDGKTIAVIGYGSQGHAHALNAKESGCNVIIGLFEGAEEWKRAEEQGFEVYTAAEAAKKADIIMILIPDEKQAVLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 213 - protein, 338 aa, Artificial sequence
  K9JM22
MAKIYYQEDCNLSLLDGKTIAVIGYGSQGHAHALNAKESGCNVIIGLFEGAEEWKRAEEQGFEVYTAAEAAKKADIIMILIPDEKQAVFYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 214 - protein, 338 aa, Artificial sequence
  K9JM23
MAKIYYQEDCNLSLLDGKTIAVIGYGSQGHAHALNAKESGCNVIIGLFEGAEEWKRAEEQGFEVYTAAEAAKKADIIMILIPDEKQAALYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 215 - protein, 338 aa, Artificial sequence
  K9JM24
MAKIYYQEDCNLSLLDGKTIAVIGYGSQGHAHALNAKESGCNVIIGLFEGAEEWKRAEEQGFEVYTAAEAAKKADIIMILIPDEKQATLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 216 - protein, 338 aa, Artificial sequence; identical to SEQ ID NO: 120
  K9JM25

SEQ ID NO: 217 - protein, 338 aa, Artificial sequence; identical to SEQ ID NO: 121
  K9JM26

SEQ ID NO: 218 - protein, 338 aa, Artificial sequence; identical to SEQ ID NO: 119
  K9JM27

SEQ ID NO: 219 - protein, 338 aa, Artificial sequence
  K9JM28
MAKIYYQEDCNLSLLDGKTIAVIGYGSQGHAHALNAKESGCNVIIGLFEGAEEWKRAEEQGFEVYTAAEAAKKADIIMILIPDEMQAIIYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 220 - protein, 338 aa, Artificial sequence; identical to SEQ ID NO: 111
  K9JM29

SEQ ID NO: 221 - protein, 338 aa, Artificial sequence
  K9JM30
MAKIYYQEDCNLSLLDGKTIAVIGYGSQGHAHALNAKESGCNVIIGLFEGAEEWKRAEEQGFEVYTAAEAAKKADIIMILIPDEKQAIIYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 222 - protein, 338 aa, Artificial sequence
  K9JM31
MAKIYYQEDCNLSLLDGKTIAVIGYGSQGHAHALNAKESGCNVIIGLFEGAEEWKRAEEQGFEVYTAAEAAKKADIIMILIPDEKQATFYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 223 - protein, 338 aa, Artificial sequence
  JM32
MAKIYYQEDCNLSLLDGKTIAVIGYGSQGHAHALNAKESGCNVIIGLFEGAEEWKRAEEQGFEVYTAAEAAKKADIIMILIPDEMQAAFYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 224 - protein, 338 aa, Artificial sequence
  JM33
MAKIYYQEDCNLSLLDGKTIAVIGYGSQGHAHALNAKESGCNVIIGLFEGAEEWKRAEEQGFEVYTAAEAAKKADIIMILIPDEMQAVLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 225 - protein, 338 aa, Artificial sequence; identical to SEQ ID NO: 116
  JM34

SEQ ID NO: 226 - protein, 338 aa, Artificial sequence; identical to SEQ ID NO: 200
  JM35

SEQ ID NO: 227 - protein, 338 aa, Artificial sequence
  JM36
MAKIYYQEDCNLSLLDGKTIAVIGYGSQGHAHALNAKESGCNVIIGLFEGAEEWKRAEEQGFEVYTAAEAAKKADIIMILIPDEYQAALYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 228 - protein, 338 aa, Artificial sequence; identical to SEQ ID NO: 125
  JM37

SEQ ID NO: 229 - protein, 338 aa, Artificial sequence
  JM38
MAKIYYQEDCNLSLLDGKTIAVIGYGSQGHAHALNAKESGCNVIIGLFEGAEEWKRAEEQGFEVYTAAEAAKKADIIMILIPDEYQAILYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 230 - protein, 338 aa, Artificial sequence; identical to SEQ ID NO: 124
  JM39

SEQ ID NO: 231 - protein, 338 aa, Artificial sequence
  JM40
MAKIYYQEDCNLSLLDGKTIAVIGYGSQGHAHALNAKESGCNVIIGLFEGAEEWKRAEEQGFEVYTAAEAAKKADIIMILIPDEYQATFYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 232 - protein, 338 aa, Artificial sequence
  JM42
MAKIYYQEDCNLSLLDGKTIAVIGYGSQGHAHALNAKESGCNVIIGLFEGAEEWKRAEEQGFEVYTAAEAAKKADIIMILIPDEYQAVFYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 233 - protein, 338 aa, Artificial sequence
  JM43
MAKIYYQEDCNLSLLDGKTIAVIGYGSQGHAHALNAKESGCNVIIGLFEGAEEWKRAEEQGFEVYTAAEAAKKADIIMILIPDEYQAVLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 234 - protein, 338 aa, Artificial sequence; identical to SEQ ID NO: 126
  JM44

SEQ ID NO: 235 - protein, 343 aa, Artificial sequence
  K9SB2
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 236 - DNA, 12319 bp, Artificial sequence
  K9_David_SH
aggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaatgcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgc

SEQ ID NO: 237 - protein, 338 aa, Artificial sequence
  K9ALL3
MAKIYYQEDCNLSLLDGKTIAVIGYGSQGHAHALNAKESGCNVIIGLFEGAEEWKRAEEQGFEVYTAAEAAKKADIIMILIPDEAQALLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 238 - DNA, 4978 bp, Artificial sequence
  JEA1.PS.pBAD plasmid
aagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggctaacaggaggaagtttaaacagtatgaaagttttctacgataaagactgcgacctgtcgatcatccaaggtaagaaagttgccatcatcggcttcggttcccagggccacgctcaagcactcaacctgaaggattccggcgtagacgtgactgttggcctgcctaaaggctttgctgatgtagccaaggctgaagcccacggctttaaagtgaccgacgttgctgcagccgttgccggtgccgacttggtcatgatcctgattccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggaggtattcctgacctgatcgcgatctaccaggacgtttccggcaacgccaagaacgtcgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaatacgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaagccaagaactaaggccctgcaggccttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagag

SEQ ID NO: 239 - protein, 343 aa, Artificial sequence [sequence omitted]

SEQ ID NO: 240 - protein, 338 aa, Artificial sequence; identical to SEQ ID NO: 202
  JM41

SEQ ID NO: 241 - protein, 338 aa, Artificial sequence
  K9ALL148
MAKIYYQEDCNLSLLDGKTIAVIGYGSQGHAHALNAKESGCNVIIGLFEGAEEWKRAEEQGFEVYTAAEAAKKADIIMILIPDEAQALLYKNDIEPNLEAGNMLMFAHGFNIHFGCIVPPKDVDVTMIAPKGPGHTVRSEYEGGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 242 - protein, 338 aa, Artificial sequence
  K9JM148
MAKIYYQEDCNLSLLDGKTIAVIGYGSQGHAHALNAKESGCNVIIGLFEGAEEWKRAEEQGFEVYTAAEAAKKADIIMILIPDEYQATLYKNDIEPNLEAGNMLMFAHGFNIHFGCIVPPKDVDVTMIAPKGPGHTVRSEYEGGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 243 - protein, 338 aa, Artificial sequence
  K9ALL156
MAKIYYQEDCNLSLLDGKTIAVIGYGSQGHAHALNAKESGCNVIIGLFEGAEEWKRAEEQGFEVYTAAEAAKKADIIMILIPDEAQALLYKNDIEPNLEAGNMLMFAHGFNIHFGCIVPPKDVDVTMIAPKGPGHTVRSEYEEGKGVPCLAAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 244 - protein, 338 aa, Artificial sequence
  K9JM156
MAKIYYQEDCNLSLLDGKTIAVIGYGSQGHAHALNAKESGCNVIIGLFEGAEEWKRAEEQGFEVYTAAEAAKKADIIMILIPDEYQATLYKNDIEPNLEAGNMLMFAHGFNIHFGCIVPPKDVDVTMIAPKGPGHTVRSEYEEGKGVPCLAAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 245 - protein, 338 aa, Artificial sequence
  K9ALL191
MAKIYYQEDCNLSLLDGKTIAVIGYGSQGHAHALNAKESGCNVIIGLFEGAEEWKRAEEQGFEVYTAAEAAKKADIIMILIPDEAQALLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRSETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 246 - protein, 338 aa, Artificial sequence
  K9JM191
MAKIYYQEDCNLSLLDGKTIAVIGYGSQGHAHALNAKESGCNVIIGLFEGAEEWKRAEEQGFEVYTAAEAAKKADIIMILIPDEYQATLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRSETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 247 - protein, 338 aa, Artificial sequence
  K9ALL254
MAKIYYQEDCNLSLLDGKTIAVIGYGSQGHAHALNAKESGCNVIIGLFEGAEEWKRAEEQGFEVYTAAEAAKKADIIMILIPDEAQALLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRFSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 248 - protein, 338 aa, Artificial sequence
  K9ALL278
MAKIYYQEDCNLSLLDGKTIAVIGYGSQGHAHALNAKESGCNVIIGLFEGAEEWKRAEEQGFEVYTAAEAAKKADIIMILIPDEAQALLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKMAMKKILSDIQDGTFAKDFLVDMSDAGSQVHFKAMRKLASEHPAEVVGEEIRSLYSWSDEDKLINN

SEQ ID NO: 249 - protein, 338 aa, Artificial sequence
  K9ALL37
MAKIYYQEDCNLSLLDGKTIAVIGYGSQGHANALNAKESGCNVIIGLFEGAEEWKRAEEQGFEVYTAAEAAKKADIIMILIPDEAQALLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 250 - protein, 338 aa, Artificial sequence
  K9JM37S
MAKIYYQEDCNLSLLDGKTIAVIGYGSQGHANALNAKESGCNVIIGLFEGAEEWKRAEEQGFEVYTAAEAAKKADIIMILIPDEYQATLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 251 - protein, 338 aa, Artificial sequence
  K9ALL66
MAKIYYQEDCNLSLLDGKTIAVIGYGSQGHAHALNAKESGCNVIIGLFEGAEEWKRAEEQAFEVYTAAEAAKKADIIMILIPDEAQALLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 252 - protein, 338 aa, Artificial sequence
  K9JM66
MAKIYYQEDCNLSLLDGKTIAVIGYGSQGHAHALNAKESGCNVIIGLFEGAEEWKRAEEQAFEVYTAAEAAKKADIIMILIPDEYQATLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 253 - protein, 338 aa, Artificial sequence
  K9ALL8Q
MAKIYYQEDCNLSLLDGKTIAVIGYGSQGHAHALNAKESGCNVIIGLFEGAEEWKRAEEQGFEVYTAAEAAKKADIIMILIPDEAQALLYKNDIEPNLEAGNMLMFAHGFNIHFGCIVPPKDVDVTMIAPKGPGHTVRSEYEQGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 254 - protein, 338 aa, Artificial sequence
  K9JM8Q
MAKIYYQEDCNLSLLDGKTIAVIGYGSQGHAHALNAKESGCNVIIGLFEGAEEWKRAEEQGFEVYTAAEAAKKADIIMILIPDEYQATLYKNDIEPNLEAGNMLMFAHGFNIHFGCIVPPKDVDVTMIAPKGPGHTVRSEYEQGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 255 - protein, 338 aa, Artificial sequence
  K9ALL45
MAKIYYQEDCNLSLLDGKTIAVIGYGSQGHAHALNAKESCCNVIIGLFEGAEEWKRAEEQGFEVYTAAEAAKKADIIMILIPDEAQALLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 256 - DNA, 24 bp, Artificial sequence
  K9G9_EZ_F1
aaacatggaagaatgtaagatggc

SEQ ID NO: 257 - DNA, 24 bp, Artificial sequence
  K9G9_EZ_R1
tcagttgttaatcaacttgtcttc

SEQ ID NO: 258 - DNA, 4993 bp, Artificial sequence
  K9_Ursala in pBAD
aagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggctaacaggaggaagtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgtcgaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagag

SEQ ID NO: 259 - DNA, 4978 bp, Artificial sequence
  K9JM11 in pBAD.KARI
aagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggctaacaggaggaagtttaaacagtatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaataccaggctaccttgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagag

SEQ ID NO: 260 - DNA, 20 bp, Artificial sequence
  pBAD-For
atgccatagcatttttatcc

SEQ ID NO: 261 - DNA, 22 bp, Artificial sequence
  pBAD-Rev
ctgatttaatctgtatcaggct

SEQ ID NO: 262 - DNA, 45 bp, Artificial sequence
  F53I
ggttgtaacgttatcattggtttaatcgaaggtgtggaggagtgg

SEQ ID NO: 263 - DNA, 45 bp, Artificial sequence
  F53Irev
ccactcctccacaccttcgattaaaccaatgataacgttacaacc

SEQ ID NO: 264 - DNA, 45 bp, Artificial sequence
  F53L
ggttgtaacgttatcattggtttattggaaggtgtggaggagtgg

SEQ ID NO: 265 - DNA, 45 bp, Artificial sequence
  F53Lrev
ccactcctccacaccttccaataaaccaatgataacgttacaacc

SEQ ID NO: 266 - DNA, 45 bp, Artificial sequence
  F53S
ggttgtaacgttatcattggtttatccgaaggtgtggaggagtgg

SEQ ID NO: 267 - DNA, 45 bp, Artificial sequence
  F53Srev
ccactcctccacaccttcggataaaccaatgataacgttacaacc

SEQ ID NO: 268 - DNA, 45 bp, Artificial sequence
  F53V
ggttgtaacgttatcattggtttagtcgaaggtgtggaggagtgg

SEQ ID NO: 269 - DNA, 45 bp, Artificial sequence
  F53Vrev
ccactcctccacaccttcgactaaaccaatgataacgttacaacc

SEQ ID NO: 270 - DNA, 45 bp, Artificial sequence
  F53Y
ggttgtaacgttatcattggtttatacgaaggtgtggaggagtgg

SEQ ID NO: 271 - DNA, 45 bp, Artificial sequence
  F53Yrev
ccactcctccacaccttcgtataaaccaatgataacgttacaacc

SEQ ID NO: 272 - DNA, 45 bp, Artificial sequence
  F53D
ggttgtaacgttatcattggtttagacgaaggtgtggaggagtgg

SEQ ID NO: 273 - DNA, 45 bp, Artificial sequence
  F53Drev
ccactcctccacaccttcgtctaaaccaatgataacgttacaacc

SEQ ID NO: 274 - DNA, 45 bp, Artificial sequence
  F53H
ggttgtaacgttatcattggtttacacgaaggtgtggaggagtgg

SEQ ID NO: 275 - DNA, 45 bp, Artificial sequence
  F53Hrev
ccactcctccacaccttcgtgtaaaccaatgataacgttacaacc

SEQ ID NO: 276 - DNA, 45 bp, Artificial sequence
  F53K
ggttgtaacgttatcattggtttaaaggaaggtgtggaggagtgg

SEQ ID NO: 277 - DNA, 45 bp, Artificial sequence
  F53Krev
ccactcctccacaccttcctttaaaccaatgataacgttacaacc

SEQ ID NO: 278 - DNA, 45 bp, Artificial sequence
  F53M
ggttgtaacgttatcattggtttaatggaaggtgtggaggagtgg

SEQ ID NO: 279 - DNA, 45 bp, Artificial sequence
  F53Mrev
ccactcctccacaccttccattaaaccaatgataacgttacaacc

SEQ ID NO: 280 - DNA, 45 bp, Artificial sequence
  F53N
ggttgtaacgttatcattggtttaaacgaaggtgtggaggagtgg

SEQ ID NO: 281 - DNA, 45 bp, Artificial sequence
  F53Nrev
ccactcctccacaccttcgtttaaaccaatgataacgttacaacc

SEQ ID NO: 282 - DNA, 45 bp, Artificial sequence
  F53W
ggttgtaacgttatcattggtttatgggaaggtgtggaggagtgg

SEQ ID NO: 283 - DNA, 45 bp, Artificial sequence
  F53Wrev
ccactcctccacaccttcccataaaccaatgataacgttacaacc

SEQ ID NO: 284 - DNA, 45 bp, Artificial sequence
  F53E
ggttgtaacgttatcattggtttagaagaaggtgtggaggagtgg

SEQ ID NO: 285 - DNA, 45 bp, Artificial sequence
  F53rev
ccactcctccacaccttcttctaaaccaatgataacgttacaacc

SEQ ID NO: 286 - DNA, 45 bp, Artificial sequence
  F53G
ggttgtaacgttatcattggtttaggtgaaggtgtggaggagtgg

SEQ ID NO: 287 - DNA, 45 bp, Artificial sequence
  F53Grev
ccactcctccacaccttcacctaaaccaatgataacgttacaacc

SEQ ID NO: 288 - DNA, 45 bp, Artificial sequence
  F53P
ggttgtaacgttatcattggtttaccagaaggtgtggaggagtgg

SEQ ID NO: 289 - DNA, 45 bp, Artificial sequence
  F53Prev
ccactcctccacaccttctggtaaaccaatgataacgttacaacc

SEQ ID NO: 290 - DNA, 45 bp, Artificial sequence
  F53Q
ggttgtaacgttatcattggtttacaagaaggtgtggaggagtgg

SEQ ID NO: 291 - DNA, 45 bp, Artificial sequence
  F53Qrev
ccactcctccacaccttcttgtaaaccaatgataacgttacaacc

SEQ ID NO: 292 - DNA, 45 bp, Artificial sequence
  F53A
ggttgtaacgttatcattggtttagctgaaggtgtggaggagtgg

SEQ ID NO: 293 - DNA, 45 bp, Artificial sequence
  F53Arev
ccactcctccacaccttcagctaaaccaatgataacgttacaacc

SEQ ID NO: 294 - DNA, 45 bp, Artificial sequence
  F53C
ggttgtaacgttatcattggtttatgtgaaggtgtggaggagtgg

SEQ ID NO: 295 - DNA, 45 bp, Artificial sequence
  F53Crev
ccactcctccacaccttcacataaaccaatgataacgttacaacc

SEQ ID NO: 296 - DNA, 45 bp, Artificial sequence
  F53R
ggttgtaacgttatcattggtttacgtgaaggtgtggaggagtgg

SEQ ID NO: 297 - DNA, 45 bp, Artificial sequence
  F53Rrev
ccactcctccacaccttcacgtaaaccaatgataacgttacaacc

SEQ ID NO: 298 - DNA, 45 bp, Artificial sequence
  F53T
ggttgtaacgttatcattggtttaaccgaaggtgtggaggagtgg

SEQ ID NO: 299 - DNA, 45 bp, Artificial sequence
  F53Trev
ccactcctccacaccttcggttaaaccaatgataacgttacaacc

SEQ ID NO: 300 - protein, 343 aa, Artificial sequence
  K9_Lucy
MEECKMAKIYYQEDCNLSLLDGKTIAVIGYGSQGHAHALNAKESGCNVIIGLLEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 301 - protein, 343 aa, Artificial sequence
  K9_Ilya
MEECKMAKIYYQEDCNLSLLDGKTIAVIGYGSQGHAHALNAKESGCNVIIGLIEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 302 - protein, 338 aa, Artificial sequence
  K9ALL258
MAKIYYQEDCNLSLLDGKTIAVIGYGSQGHAHALNAKESGCNVIIGLFEGAEEWKRAEEQGFEVYTAAEAAKKADIIMILIPDEAQALLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISSTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 303 - protein, 338 aa, Artificial sequence
  K9YW25-T191S
MAKIYYQEDCNLSLLDGKTIAVIGYGSQGHAHALNAKESGCNVIIGLFEGAEEWKRAEEQGFEVYTAAEAAKKADIIMILIPDEAQALMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRSETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 304 - DNA, 12304 bp, Artificial sequence
  pLH689:ALL3
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaagctcaggctttgttgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgaaacttagattagattgctatgctttctttccaatgagcaagaagtaaaaaaagttgtaatagaacaggaaaaatgaagctgaaacttgagaaattgaagaccgtttgttaactcaaatatcaatgggaggtcgtcgaaagagaacaaaatcgaaaaaaaagttttcaagagaaagaaacgtgataaaaatttttattgccttctccgacgaagaaaaagggacgaggcggtctctttttccttttccaaacctttagtacgggtaattaacggcaccctagaggaaggaggagggggaatttagtatgctgtgcttgggtgttttgaagtggtacggcggtgcgcggagtccgagaaaatctggaagagtaaaaaaggagtagagacattttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 305 - DNA, 12319 bp, Artificial sequence; identical to SEQ ID NO: 236
  K9_David_DHAD

SEQ ID NO: 306 - DNA, 12319 bp, Artificial sequence
  pLH689
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgaaacttagattagattgctatgctttctttccaatgagcaagaagtaaaaaaagttgtaatagaacaggaaaaatgaagctgaaacttgagaaattgaagaccgtttgttaactcaaatatcaatgggaggtcgtcgaaagagaacaaaatcgaaaaaaaagttttcaagagaaagaaacgtgataaaaatttttattgccttctccgacgaagaaaaagggacgaggcggtctctttttccttttccaaacctttagtacgggtaattaacggcaccctagaggaaggaggagggggaatttagtatgctgtgcttgggtgttttgaagtggtacggcggtgcgcggagtccgagaaaatctggaagagtaaaaaaggagtagagacattttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 307 - protein, 343 aa, Artificial sequence; identical to SEQ ID NO: 300
  F53L

SEQ ID NO: 308 - protein, 343 aa, Artificial sequence; identical to SEQ ID NO: 301
  F53I

SEQ ID NO: 309 - protein, 343 aa, Artificial sequence
  F53M
MEECKMAKIYYQEDCNLSLLDGKTIAVIGYGSQGHAHALNAKESGCNVIIGLMEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 310 - protein, 343 aa, Artificial sequence
  F53V
MEECKMAKIYYQEDCNLSLLDGKTIAVIGYGSQGHAHALNAKESGCNVIIGLVEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 311 - protein, 343 aa, Artificial sequence
  F53P
MEECKMAKIYYQEDCNLSLLDGKTIAVIGYGSQGHAHALNAKESGCNVIIGLPEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 312 - protein, 343 aa, Artificial sequence
  F53S
MEECKMAKIYYQEDCNLSLLDGKTIAVIGYGSQGHAHALNAKESGCNVIIGLSEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 313 - protein, 343 aa, Artificial sequence
  F53A
MEECKMAKIYYQEDCNLSLLDGKTIAVIGYGSQGHAHALNAKESGCNVIIGLAEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 314 - protein, 343 aa, Artificial sequence
  F53E
MEECKMAKIYYQEDCNLSLLDGKTIAVIGYGSQGHAHALNAKESGCNVIIGLEEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 315 - protein, 343 aa, Artificial sequence
  F53Q
MEECKMAKIYYQEDCNLSLLDGKTIAVIGYGSQGHAHALNAKESGCNVIIGLQEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 316 - protein, 343 aa, Artificial sequence
  T11-1
MEECKMAKIYYQEDCNLSLLDGKTIAVIGYGSQGHAHALNAKESGCNVIIGLFEGVEEWKRAEEQGFEVYTATEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 317 - protein, 343 aa, Artificial sequence
  T11-2
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKAMDMALAYALAIGGARAGVLETTFRSETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 318 - protein, 343 aa, Artificial sequence
  T11-3
MEECKMAKIYYQEDCNLSLLDGKTIAVIGYGYQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLIEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 319 - protein, 343 aa, Artificial sequence
  T11-4
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDSIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 320 - protein, 343 aa, Artificial sequence
  T11-5
MEECKMAKIYYQEDCNLSLLDGKTIAVIGYGSQGHAHALNAKESGSNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 321 - protein, 343 aa, Artificial sequence
  T11-6
MEECKMAKIYYQEDCNLSLLDGKTIAVIGYGSQGHAHALNAKESGCNVIIGLFEGVEEWKRAEEQGFGVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 322 - protein, 343 aa, Artificial sequence
  T11-7
MEECKMAKIYYQENCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECNHEMKLIVDLIYQSGFSGMRYSISNTAEYGDYITGPKIITEDTKKAMKKILSDIQDGTFAKDFLVDMSDAGSQVHFKVMRKLASEHPAEVVGEEIRSLYSWSDEDKLINN

SEQ ID NO: 323 - protein, 343 aa, Artificial sequence
  T11-10
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTLRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 324 - protein, 343 aa, Artificial sequence
  T11-12
MEECKMAKIYYQEDCNLSLLDGKTIAVIGYGSQGHAHALNAMESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVADEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 325 - protein, 343 aa, Artificial sequence
  T11-13
MEECKMAKIYYQEDCNLSLLDGKTIAVIGYGSQGHAHALNAKESDCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 326 - protein, 343 aa, Artificial sequence
  T11-14
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVSPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 327 - protein, 343 aa, Artificial sequence
  T11-15
MEECKMAKIYYQEDCNLSLLDGKTIAVIGYGSQGHAHALNANESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETVLFGEQAVLCGGVCALMQAGFETLVEAGYDPRNAYFECIHEMKLIVDLIYQSGFSGMRYSISNTAEYGDYITGPKIITEDTKKAMKKICSDIQDGTFAKDFLVDMSDAGSQVHFKAMRKLASEHPAEVVGEEIRSLYSWSDEDKLINN

SEQ ID NO: 328 - protein, 343 aa, Artificial sequence
  T11-16
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIESNLEAGNMLMFAHGFNIHFGCIVPPKDVDVTVIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPNIITEDTKKAMKKILSDIQDGTFAKDFLVDMSDAGSQVHFKAMRKLASEHPAEVVGEEIRSLYSWSDEDKLINN

SEQ ID NO: 329 - protein, 343 aa, Artificial sequence
  T11-18
MEECKMAKIYYQEDCNLSLLDGKTIAVIGYGSQGHAHALNAKESGCNVIIGLFEGVEEWKRAEEQGFEVYTAAEAAMKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 330 - protein, 343 aa, Artificial sequence
  T11-19
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPSKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 331 - protein, 343 aa, Artificial sequence
  T11-21
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPEGPGHTVRSEYEEGKGVPCLVAVEQDTTGKALDMALAYALAIGGARAGVLETTFRTETETDLFGEQAVLCGGVCALMQAGFETLVEAGYDPRNAYFECIHEMKLIVVLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 332 - protein, 343 aa, Artificial sequence
  T11-22
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGINIHFGCIVPPKDVDVTMIAPKGPGHTVRSEYEEGKGVPCLVAVEQDATGKALDMALAYALAIGGARAGVLETTFRTETETDLFGEQAVLCGGVCALMHAGFETLVEAGYDPRNAYFECIHEMKLIVDLIYQSGFSGMRYSISNTAENGDYITGPKIITEDTKKAMKKILSDIQDGTFAKDFLVDMSDAGSQVHFKAMRKLASEHPAEVVGEEIRSLYSWSDEDKLINN

SEQ ID NO: 333 - protein, 343 aa, Artificial sequence
  T11-25
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTIAKDFLVDMSDAGSQVHFKAMRKLASEHPAEVVGEEIRSLYSWSDEDKLINN

SEQ ID NO: 334 - protein, 343 aa, Artificial sequence
  T11-27
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMMLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 335 - protein, 343 aa, Artificial sequence
  T11-28
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLCAVEQDATGKALDMALAYALAIGGARAGVLETTFRTETETDLFGEQAVLCGGVCALMQAGFETLVEAGYDPRNAYFECIHEMKLIVDLIYQSGFSGMRYSTSNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 336 - protein, 343 aa, Artificial sequence
  T11-29
MEECKMAKIYYQEDCNLSLLDGKTIAVIGYGSQGHAHALNAKESGCNVIIGLFEGVEEWKRAEEQGFEVYTAAEAAKKADIIMILIPDEKQATLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 337 - protein, 343 aa, Artificial sequence
  T11-30
MEECKMAKIYYQEDCNLSLLDGKTIAVIGYGSQGHAHALNAKESGCNVIIGLLEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVSALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRYLYSWSDEDKLINN

SEQ ID NO: 338 - protein, 343 aa, Artificial sequence
  T11-32
MEECKMAKIYYQEDCNLSLLDGKTIAVIGYGSQGHAHALNAKESGCNVIIGLFEGVEEWKRAEEQGFEVYTAAEAAKKADIIMILIPDEKRATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCDLMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 339 - protein, 343 aa, Artificial sequence
  T11-33
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVSVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 340 - protein, 343 aa, Artificial sequence
  T11-35
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGSMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 341 - protein, 343 aa, Artificial sequence
  T11-36
MEECKMAKIYYQEDCNLSLLDGKTIAVIGYGSQGHAHALNAKESGCNVIIGLIEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAMDFLVDMSDAGSQVHFKAMRKLASEHPAEVVGEEIRSLYSWSDEDKLINN

SEQ ID NO: 342 - protein, 343 aa, Artificial sequence; identical to SEQ ID NO: 235
  T11-37

SEQ ID NO: 343 - protein, 343 aa, Artificial sequence
  T11-38
MEECKMAKIYYQEDCNLSLLDGKTNAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIYEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 344 - protein, 343 aa, Artificial sequence
  T11-39
MEECKMAKIYYQEDCNLSLLDGKTIAVIGYGSQGHAHALNAKESGCNVIIGLFEGVEEWKRAEEQGFEVYTAAEAAKKADIIMNLIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLYGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 345 - protein, 343 aa, Artificial sequence
  T11-42
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRHSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 346 - protein, 343 aa, Artificial sequence; identical to SEQ ID NO: 235
  T11-43

SEQ ID NO: 347 - protein, 343 aa, Artificial sequence
  T11-44
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHCFNIHFGCIVPPKDVDVTMIAPKGPGHTVRSEYEEGKGVPCLVAVEQDATGKALDMALAYALAIGGARAGVLETTFRTETDTDLFGEQAVLCGGVCASMQAGFETLVEAGYEPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 348 - protein, 343 aa, Artificial sequence
  T11-45
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKTLDMASAYALAIGGARAGVLETTFRTETETDLFGEQAVLCGGVCALMQAGFEILVEAGYDPRNAYFECIHEMKLIVDLIYQSCFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 349 - protein, 343 aa, Artificial sequence
  T11-46
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYENDIEPNLEAGNMLMFAHGFNIHFGCIAPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 350 - protein, 343 aa, Artificial sequence
  T11-47
MEECKMAKIYYQEDCNLSLLDGKTIAVIGYGSQGHAHALNAKESGCNVIIGLIEGVEEWKRAEEQGFEVYTAAEAAKKADIIMILIPDEKQATMYKNDIEPNLEAGNLLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 351 - protein, 343 aa, Artificial sequence
  T11-49
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLDTTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 352 - protein, 343 aa, Artificial sequence; identical to SEQ ID NO: 301
  T11-50

SEQ ID NO: 353 - protein, 343 aa, Artificial sequence
  T11-52
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSEAGSQVHFKAMRKLASEHPAEVVGEEIRSLYSWSDEDKLINN

SEQ ID NO: 354 - protein, 343 aa, Artificial sequence
  T11-54
MEECKMAKIYYQEDCNLSLLDGKTIAVIGYGSQGHAHALNAKESGCNVIIGLFEGVEDWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 355 - protein, 343 aa, Artificial sequence
  T11-55
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEADYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 356 - protein, 343 aa, Artificial sequence
  T11-56
MEECKMAKIYYQEDCNLSLLDGKTIAVIGYGSQGHAHALNAKESGCNVIIGLFEGVEEWKRAEEQGFEVYTAAEAAKKADIIMILIPDEKQAAMYKNDIEPNLEAGNMLMFAHDFNIHFGCIVPPKDVDVTMIAPKGPGHTVRSEYEEGKSVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 357 - protein, 343 aa, Artificial sequence; identical to SEQ ID NO: 353
  T11-57

SEQ ID NO: 358 - protein, 343 aa, Artificial sequence
  T11-58
MEECKMAKIYYQEDCNLSLLDGKTIAVIGYGSQGHAHALNANESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKNFLSDIQDGTFAKDFLVDMSDAGSQVHFKAMRKLASEHPAEVVGEEIRSLYSWSDEDKLINN

SEQ ID NO: 359 - protein, 343 aa, Artificial sequence
  T11-59
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFSCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 360 - protein, 343 aa, Artificial sequence
  T11-60
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRNETETDLFGEQAVLCGGVCALMQAGFETLVEAGYDPRNAYFECIHEMKLIVDLIYQSGFSGMRHSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 361 - protein, 343 aa, Artificial sequence
  T11-61
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIAPPMDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 362 - protein, 343 aa, Artificial sequence
  T11-62
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMMKILSDIQDGTFAKDFLVDMSDAGSQVHFKAMRKLASEHPAEVVGEEIRSLYSWSDEDKLINN

SEQ ID NO: 363 - protein, 343 aa, Artificial sequence
  T11-64
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYDLAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 364 - protein, 343 aa, Artificial sequence
  T11-66
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTFRSEYEEGKGVPCLVAVEQDATGKALEMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 365 - protein, 343 aa, Artificial sequence
  T11-67
MEECKMAKIYYQEDCNLSLLDGKTIAVIGYGSQGHAHALNAKESGCNVIIGLFEGVEEWKRAEEQGFEVYTAAEAAKKADIIMILIPDEKQDTMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 366 - protein, 343 aa, Artificial sequence
  T11-69
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDKALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 367 - protein, 343 aa, Artificial sequence
  T11-70
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITKDTKKAMKKILSDIQDGTFAKDFLVDMSDAGSQVHFKAMRKLASEHPAEVVGEEIRSLYSWSDEDKLINN

SEQ ID NO: 368 - protein, 343 aa, Artificial sequence
  T11-72
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALTIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 369 - protein, 343 aa, Artificial sequence
  T11-74
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQVGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 370 - protein, 343 aa, Artificial sequence
  T11-75
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDVEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCTLMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 371 - protein, 343 aa, Artificial sequence
  T11-76
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRSETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 372 - protein, 343 aa, Artificial sequence
  T11-79
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLESTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 373 - protein, 343 aa, Artificial sequence
  T11-80
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETWVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 374 - protein, 343 aa, Artificial sequence; identical to SEQ ID NO: 371
  T11-81

SEQ ID NO: 375 - protein, 343 aa, Artificial sequence; identical to SEQ ID NO: 301
  T11-83

SEQ ID NO: 376 - protein, 343 aa, Artificial sequence
  T11-84
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDACSQVHFKAMRKLASEHPAEVVGEEIRSLYSWSDEDKLINN

SEQ ID NO: 377 - protein, 343 aa, Artificial sequence
  T11-85
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLETGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 378 - protein, 343 aa, Artificial sequence
  T11-86
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVRALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 379 - protein, 343 aa, Artificial sequence
  T11-87
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIESNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 380 - protein, 343 aa, Artificial sequence
  T11-88
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKTMKKILSDIQDGTFAKDFLVDMSDAGSQVHFKAMRKLASEHPAEVVGEEIRSLYSWSDEDKLINN

SEQ ID NO: 381 - protein, 343 aa, Artificial sequence
  T11-91
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFSCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDTGSQVHFKAMRMLASEHPAEVVGEEIRSLYSWSDEDKLINN

SEQ ID NO: 382 - protein, 343 aa, Artificial sequence
  T11-94
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKINTEDTKKAMKKILSDIQDGTFAKDFLVDMSDAGSQVHFKAMRKLASEHPAEVVGEEIRSLYSWSDEDKLINN

SEQ ID NO: 383 - protein, 343 aa, Artificial sequence
  T11-95
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGAKAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 384 - protein, 343 aa, Artificial sequence
  T11-96
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSVYEEGKGVPCLVAVEQDATGKALDMALAYALAIGGARAGVLETTFRTETETDLFGEQAVLCGGVCALMQTGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 385 - protein, 343 aa, Artificial sequence
  T11-97
MEECKMAKIYYQEDCNLSLLDGKTIAVIGYGSQGHAHALNAKESGCNVIIGLFEGVEEWKRAEEQGFEVYTAAEAAKKADIIMILIPDEKQAIMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 386 - protein, 343 aa, Artificial sequence
  T11-99
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKEVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 387 - protein, 343 aa, Artificial sequence
  T11-103
MEECKMAKIYYQEDCNLSLLDGKTIAVIGYGSQGHAHALDAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRSETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 388 - protein, 343 aa, Artificial sequence
  T11-104
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGSVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGKEIRSLYSWSDEDKLINN

SEQ ID NO: 389 - protein, 343 aa, Artificial sequence
  T11-109
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKEFLVDMSDAGSQVHFKAMRKLASEHPAEVVGEEIRSLYSWSDEDKLINN

SEQ ID NO: 390 - protein, 343 aa, Artificial sequence
  T11-110
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYDEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 391 - protein, 343 aa, Artificial sequence
  T11-111
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEECKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLADMSDAGSQVHFKAMRKLASEHPAEVVGEEIRSLYSWSDEDKLINN

SEQ ID NO: 392 - protein, 343 aa, Artificial sequence
  T11-114
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIISEDTKKAMKKILSDIQDGTFAKDFLVDMSDAGSQVHFKAMRKLASEHPAEVVGEEIRSLYSWSDEDKLINN

SEQ ID NO: 393 - protein, 343 aa, Artificial sequence
  T11-116
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVAMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 394 - protein, 343 aa, Artificial sequence
  T11-117
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCFVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 395 - protein, 343 aa, Artificial sequence
  T11-119
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGVYITGPKIITEDTKKAMKKILSDIQDGTFAKDFLVDMSDAGSQVHFKAMRKLASEHPAEVVGEEIRSLYSWSDEDKLINN

SEQ ID NO: 396 - protein, 343 aa, Artificial sequence
  T11-121
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIYFGCIVPPKDVDVTMIAPKGPGHTVRSEYEEGKGVPCLVAVEQDATGKALDMALAYALAIGGARAGVLETTFGTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 397 - protein, 343 aa, Artificial sequence
  T11-122
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKMASEHPAEVVGEEIRSLYSWSDEDKLINN

SEQ ID NO: 398 - protein, 343 aa, Artificial sequence; identical to SEQ ID NO: 395
  T11-124

SEQ ID NO: 399 - protein, 343 aa, Artificial sequence
  T11-125
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVNLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 400 - protein, 343 aa, Artificial sequence
  T11-128
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAIRKLASEHPAEVVGEEIRSLYSWSDEDKLINN

SEQ ID NO: 401 - protein, 343 aa, Artificial sequence
  T11-130
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILYDIQDGTFAKDFLVDMSDAGSQVHFKAMRKLASEHPAEVVGEEIRSLYSWSDEDKLINN

SEQ ID NO: 402 - protein, 343 aa, Artificial sequence
  T11-131
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECMHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 403 - protein, 343 aa, Artificial sequence
  T11-134
MEECKMAKIYYQEDCNLSLLDGKTIAVIGYGSQGHAHALNAKESGCNVIIGLFEGVEEWKRAEEQGFEVYTAAEAAKKADIIMIMIPDEKQATMYKNDIEPNLEAGNMLMFAHGFNIHFGCIVPPKDVDVTMIAPKGPGYTVRSEYEEGKGVPCLVAVEQDATGKALDMALAYALAIGGARAGVLETTFRTETETDLFGEQAVLCGGVCALMQAGFETLVEAGYDPRNAYFECIHELKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 404 - protein, 338 aa, Artificial sequence
  G164D
MAKIYYQEDCNLSLLDGKTIAVIGYGSQGHAHALNAKESGCNVIIGLLEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATDKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 405 - protein, 338 aa, Artificial sequence
  G304V
MAKIYYQEDCNLSLLDGKTIAVIGYGSQGHAHALNAKESGCNVIIGLLEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAVSQVHFKAMRKLASEHPAEVVGEEIRSLYSWSDEDKLINN

SEQ ID NO: 406 - protein, 338 aa, Artificial sequence
  N258S
MAKIYYQEDCNLSLLDGKTIAVIGYGSQGHAHALNAKESGCNVIIGLLEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISSTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 407 - protein, 338 aa, Artificial sequence
  T71S
MAKIYYQEDCNLSLLDGKTIAVIGYGSQGHAHALNAKESGCNVIIGLLEGVEEWKRAEEQGFEVYSAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 408 - protein, 338 aa, Artificial sequence
  V184I
MAKIYYQEDCNLSLLDGKTIAVIGYGSQGHAHALNAKESGCNVIIGLLEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGILETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 409 - protein, 338 aa, Artificial sequence
  A279D
MAKIYYQEDCNLSLLDGKTIAVIGYGSQGHAHALNAKESGCNVIIGLLEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKDMKKILSDIQDGTFAKDFLVDMSDAGSQVHFKAMRKLASEHPAEVVGEEIRSLYSWSDEDKLINN

SEQ ID NO: 410 - protein, 338 aa, Artificial sequence
  D98V
MAKIYYQEDCNLSLLDGKTIAVIGYGSQGHAHALNAKESGCNVIIGLLEGVEEWKRAEEQGFEVYTAAEAAKKADIIMILIPDEKQATMYKNVIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 411 - protein, 338 aa, Artificial sequence
  M169F
MAKIYYQEDCNLSLLDGKTIAVIGYGSQGHAHALNAKESGCNVIIGLLEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDFALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 412 - protein, 338 aa, Artificial sequence
  M169K
MAKIYYQEDCNLSLLDGKTIAVIGYGSQGHAHALNAKESGCNVIIGLLEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDKALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 413 - protein, 338 aa, Artificial sequence
  M169L
MAKIYYQEDCNLSLLDGKTIAVIGYGSQGHAHALNAKESGCNVIIGLLEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDLALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 414 - protein, 338 aa, Artificial sequence
  E100Q_M312K
MAKIYYQEDCNLSLLDGKTIAVIGYGSQGHAHALNAKESGCNVIIGLLEGVEEWKRAEEQGFEVYTAAEAAKKADIIMILIPDEKQATMYKNDIQPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAKRKLASEHPAEVVGEEIRSLYSWSDEDKLINN

SEQ ID NO: 415 - DNA, 24 bp, Artificial Sequence
  K9_309TReversePrimer
ctttctcatagccttagtgtggac

SEQ ID NO: 416 - DNA, 23 bp, Artificial Sequence
  K9_158CForwardPrimer
gcttggttgcttgtgaacaagac

SEQ ID NO: 417 - DNA, 23 bp, Artificial Sequence
  K9_158SForwardPrimer
gcttggttgcttctgaacaagac

SEQ ID NO: 418 - DNA, 23 bp, Artificial Sequence
  K9_158LForwardPrimer
gcttggttgctttggaacaagac

SEQ ID NO: 419 - DNA, 23 bp, Artificial Sequence
  K9_158FForwardPrimer
gcttggttgcttttgaacaagac

SEQ ID NO: 420 - DNA, 23 bp, Artificial Sequence
  K9_158YForwardPrimer
gcttggttgcttatgaacaagac

SEQ ID NO: 421 - DNA, 23 bp, Artificial Sequence
  K9_158WForwardPrimer
gcttggttgcttgggaacaagac

SEQ ID NO: 422 - DNA, 23 bp, Artificial Sequence
  K9_158PForwardPrimer
gcttggttgctccagaacaagac

SEQ ID NO: 423 - DNA, 23 bp, Artificial Sequence
  K9_158HForwardPrimer
gcttggttgctcatgaacaagac

SEQ ID NO: 424 - DNA, 23 bp, Artificial Sequence
  K9_158QForwardPrimer
gcttggttgctcaagaacaagac

SEQ ID NO: 425 - DNA, 23 bp, Artificial Sequence
  K9_158AForwardPrimer
gcttggttgctgctgaacaagac

SEQ ID NO: 426 - DNA, 23 bp, Artificial Sequence
  K9_158DForwardPrimer
gcttggttgctgatgaacaagac

SEQ ID NO: 427 - DNA, 23 bp, Artificial Sequence
  K9_158EForwardPrimer
gcttggttgctgaagaacaagac

SEQ ID NO: 428 - DNA, 23 bp, Artificial Sequence
  K9_158GForwardPrimer
gcttggttgctggtgaacaagac

SEQ ID NO: 429 - DNA, 23 bp, Artificial Sequence
  K9_158IForwardPrimer
gcttggttgctattgaacaagac

SEQ ID NO: 430 - DNA, 23 bp, Artificial Sequence
  K9_158MForwardPrimer
gcttggttgctatggaacaagac

SEQ ID NO: 431 - DNA, 23 bp, Artificial Sequence
  K9_158TForwardPrimer
gcttggttgctactgaacaagac

SEQ ID NO: 432 - DNA, 23 bp, Artificial Sequence
  K9_158RForwardPrimer
gcttggttgctagagaacaagac

SEQ ID NO: 433 - DNA, 23 bp, Artificial Sequence
  K9_158KForwardPrimer
gcttggttgctaaggaacaagac

SEQ ID NO: 434 - DNA, 23 bp, Artificial Sequence
  K9_158NForwardPrimer
gcttggttgctaacgaacaagac

SEQ ID NO: 435 - DNA, 21 bp, Artificial Sequence
  K9_67L Forward Primer
gaagaacaaggtttggaagtc

SEQ ID NO: 436 - DNA, 21 bp, Artificial Sequence
  K9_67C Forward Primer
gaagaacaaggttgtgaagtc

SEQ ID NO: 437 - DNA, 21 bp, Artificial Sequence
  K9_67S Forward Primer
gaagaacaaggttctgaagtc

SEQ ID NO: 438 - DNA, 21 bp, Artificial Sequence
  K9_67Y Forward Primer
gaagaacaaggttatgaagtc

SEQ ID NO: 439 - DNA, 21 bp, Artificial Sequence
  K9_67W Forward Primer
gaagaacaaggttgggaagtc

SEQ ID NO: 440 - DNA, 21 bp, Artificial Sequence
  K9_67V Forward Primer
gaagaacaaggtgttgaagtc

SEQ ID NO: 441 - DNA, 21 bp, Artificial Sequence
  K9_67A Forward Primer
gaagaacaaggtgctgaagtc

SEQ ID NO: 442 - DNA, 21 bp, Artificial Sequence
  K9_67D Forward Primer
gaagaacaaggtgatgaagtc

SEQ ID NO: 443 - DNA, 21 bp, Artificial Sequence
  K9_67E Forward Primer
gaagaacaaggtgaagaagtc

SEQ ID NO: 444 - DNA, 21 bp, Artificial Sequence
  K9_67G Forward Primer
gaagaacaaggtggtgaagtc

SEQ ID NO: 445 - DNA, 21 bp, Artificial Sequence
  K9_67I Forward Primer
gaagaacaaggtattgaagtc

SEQ ID NO: 446 - DNA, 21 bp, Artificial Sequence
  K9_67M Forward Primer
gaagaacaaggtatggaagtc

SEQ ID NO: 447 - DNA, 21 bp, Artificial Sequence
  K9_67T Forward Primer
gaagaacaaggtactgaagtc

SEQ ID NO: 448 - DNA, 21 bp, Artificial Sequence
  K9_67R Forward Primer
gaagaacaaggtagagaagtc

SEQ ID NO: 449 - DNA, 21 bp, Artificial Sequence
  K9_67K Forward Primer
gaagaacaaggtaaggaagtc

SEQ ID NO: 450 - DNA, 21 bp, Artificial Sequence
  K9_67N Forward Primer
gaagaacaaggtaacgaagtc

SEQ ID NO: 451 - DNA, 21 bp, Artificial Sequence
  K9_67Q Forward Primer
gaagaacaaggtcaagaagtc

SEQ ID NO: 452 - DNA, 21 bp, Artificial Sequence
  K9_67H Forward Primer
gaagaacaaggtcatgaagtc

SEQ ID NO: 453 - DNA, 21 bp, Artificial Sequence
  K9_67P Forward Primer
gaagaacaaggtccagaagtc

SEQ ID NO: 454 - DNA, 21 bp, Artificial Sequence
  K9_162V Forward Primer
gtcgaacaagacgttactggc

SEQ ID NO: 455 - DNA, 21 bp, Artificial Sequence
  K9_162D Forward Primer
gtcgaacaagacgatactggc

SEQ ID NO: 456 - DNA, 21 bp, Artificial Sequence
  K9_162E Forward Primer
gtcgaacaagacgaaactggc

SEQ ID NO: 457 - DNA, 21 bp, Artificial Sequence
  K9_162G Forward Primer
gtcgaacaagacggtactggc

SEQ ID NO: 458 - DNA, 21 bp, Artificial Sequence
  K9_162F Forward Primer
gtcgaacaagactttactggc

SEQ ID NO: 459 - DNA, 21 bp, Artificial Sequence
  K9_162L Forward Primer
gtcgaacaagacttgactggc

SEQ ID NO: 460 - DNA, 21 bp, Artificial Sequence
  K9_162C Forward Primer
gtcgaacaagactgtactggc

SEQ ID NO: 461 - DNA, 21 bp, Artificial Sequence
  K9_162S Forward Primer
gtcgaacaagactctactggc

SEQ ID NO: 462 - DNA, 21 bp, Artificial Sequence
  K9_162Y Forward Primer
gtcgaacaagactatactggc

SEQ ID NO: 463 - DNA, 21 bp, Artificial Sequence
  K9_162W Forward Primer
gtcgaacaagactggactggc

SEQ ID NO: 464 - DNA, 21 bp, Artificial Sequence
  K9_162I Forward Primer
gtcgaacaagacattactggc

SEQ ID NO: 465 - DNA, 21 bp, Artificial Sequence
  K9_162M Forward Primer
gtcgaacaagacatgactggc

SEQ ID NO: 466 - DNA, 21 bp, Artificial Sequence
  K9_162T Forward Primer
gtcgaacaagacactactggc

SEQ ID NO: 467 - DNA, 21 bp, Artificial Sequence
  K9_162R Forward Primer
gtcgaacaagacagaactggc

SEQ ID NO: 468 - DNA, 21 bp, Artificial Sequence
  K9_162K Forward Primer
gtcgaacaagacaagactggc

SEQ ID NO: 469 - DNA, 21 bp, Artificial Sequence
  K9_162N Forward Primer
gtcgaacaagacaacactggc

SEQ ID NO: 470 - DNA, 21 bp, Artificial Sequence
  K9_162Q Forward Primer
gtcgaacaagaccaaactggc

SEQ ID NO: 471 - DNA, 21 bp, Artificial Sequence
  K9_162H Forward Primer
gtcgaacaagaccatactggc

SEQ ID NO: 472 - DNA, 21 bp, Artificial Sequence
  K9_162P Forward Primer
gtcgaacaagacccaactggc

SEQ ID NO: 473 - DNA, 24 bp, Artificial Sequence
  K9_219 Reverse Primer
gaagctgctaagaaggctgacatc

SEQ ID NO: 474 - DNA, 22 bp, Artificial Sequence
  K9_312Y Forward Primer
ggaggccaactttcttatagcc

SEQ ID NO: 475 - DNA, 22 bp, Artificial Sequence
  K9_312A Forward Primer
ggaggccaactttctagcagcc

SEQ ID NO: 476 - DNA, 22 bp, Artificial Sequence
  K9_312L Forward Primer
ggaggccaactttcttaaagcc

SEQ ID NO: 477 - DNA, 22 bp, Artificial Sequence
  K9_312R Forward Primer
ggaggccaactttcttctagcc

SEQ ID NO: 478 - DNA, 22 bp, Artificial Sequence
  K9_312K Forward Primer
ggaggccaactttcttttagcc

SEQ ID NO: 479 - DNA, 22 bp, Artificial Sequence
  K9_312F Forward Primer
ggaggccaactttctaaaagcc

SEQ ID NO: 480 - DNA, 22 bp, Artificial Sequence
  K9_312P Forward Primer
ggaggccaactttctaggagcc

SEQ ID NO: 481 - DNA, 22 bp, Artificial Sequence
  K9_312N Forward Primer
ggaggccaactttctattagcc

SEQ ID NO: 482 - DNA, 22 bp, Artificial Sequence
  K9_312I Forward Primer
ggaggccaactttctaatagcc

SEQ ID NO: 483 - DNA, 22 bp, Artificial Sequence
  K9_312C Forward Primer
ggaggccaactttctacaagcc

SEQ ID NO: 484 - DNA, 22 bp, Artificial Sequence
  K9_312H Forward Primer
ggaggccaactttctatgagcc

SEQ ID NO: 485 - DNA, 22 bp, Artificial Sequence
  K9_312V Forward Primer
ggaggccaactttctaacagcc

SEQ ID NO: 486 - DNA, 22 bp, Artificial Sequence
  K9_312D Forward Primer
ggaggccaactttctatcagcc

SEQ ID NO: 487 - DNA, 22 bp, Artificial Sequence
  K9_312G Forward Primer
ggaggccaactttctaccagcc

SEQ ID NO: 488 - DNA, 22 bp, Artificial Sequence
  K9_312S Forward Primer
ggaggccaactttctagaagcc

SEQ ID NO: 489 - DNA, 22 bp, Artificial Sequence
  K9_312T Forward Primer
ggaggccaactttctagtagcc

SEQ ID NO: 490 - DNA, 22 bp, Artificial Sequence
  K9_312Q Forward Primer
ggaggccaactttctttgagcc

SEQ ID NO: 491 - DNA, 22 bp, Artificial Sequence
  K9_312E Forward Primer
ggaggccaactttctttcagcc

SEQ ID NO: 492 - DNA, 22 bp, Artificial Sequence
  K9_312W Forward Primer
ggaggccaactttctccaagcc

SEQ ID NO: 493 - DNA, 25 bp, Artificial Sequence
  K9_169I Forward Primer
gcaaggctttggatattgctttggc

SEQ ID NO: 494 - DNA, 25 bp, Artificial Sequence
  K9_169V Forward Primer
gcaaggctttggatgttgctttggc

SEQ ID NO: 495 - DNA, 25 bp, Artificial Sequence
  K9_169R Forward Primer
gcaaggctttggatagagctttggc

SEQ ID NO: 496 - DNA, 25 bp, Artificial Sequence
  K9_169T Forward Primer
gcaaggctttggatactgctttggc

SEQ ID NO: 497 - DNA, 25 bp, Artificial Sequence
  K9_169K Forward Primer
gcaaggctttggataaggctttggc

SEQ ID NO: 498 - DNA, 25 bp, Artificial Sequence
  K9_169N Forward Primer
gcaaggctttggataacgctttggc

SEQ ID NO: 499 - DNA, 25 bp, Artificial Sequence
  K9_169A Forward Primer
gcaaggctttggatgctgctttggc

SEQ ID NO: 500 - DNA, 25 bp, Artificial Sequence
  K9_169D Forward Primer
gcaaggctttggatgatgctttggc

SEQ ID NO: 501 - DNA, 25 bp, Artificial Sequence
  K9_169E Forward Primer
gcaaggctttggatgaagctttggc

SEQ ID NO: 502 - DNA, 25 bp, Artificial Sequence
  K9_169G Forward Primer
gcaaggctttggatggtgctttggc

SEQ ID NO: 503 - DNA, 25 bp, Artificial Sequence
  K9_169F Forward Primer
gcaaggctttggattttgctttggc

SEQ ID NO: 504 - DNA, 25 bp, Artificial Sequence
  K9_169L Forward Primer
gcaaggctttggatttggctttggc

SEQ ID NO: 505 - DNA, 25 bp, Artificial Sequence
  K9_169C Forward Primer
gcaaggctttggattgtgctttggc

SEQ ID NO: 506 - DNA, 25 bp, Artificial Sequence
  K9_169S Forward Primer
gcaaggctttggattctgctttggc

SEQ ID NO: 507 - DNA, 25 bp, Artificial Sequence
  K9_169Y Forward Primer
gcaaggctttggattatgctttggc

SEQ ID NO: 508 - DNA, 25 bp, Artificial Sequence
  K9_169W Forward Primer
gcaaggctttggattgggctttggc

SEQ ID NO: 509 - DNA, 25 bp, Artificial Sequence
  K9_169P Forward Primer
gcaaggctttggatccagctttggc

SEQ ID NO: 510 - DNA, 25 bp, Artificial Sequence
  K9_169H Forward Primer
gcaaggctttggatcatgctttggc

SEQ ID NO: 511 - DNA, 25 bp, Artificial Sequence
  K9_169Q Forward Primer
gcaaggctttggatcaagctttggc

SEQ ID NO: 512 - DNA, 1017 bp, Artificial Sequence
  ECB11
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgaccttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgcttgggaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 513 - DNA, 1017 bp, Artificial Sequence
  EC2a2
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctaaggaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 514 - DNA, 1017 bp, Artificial Sequence
  EC2B12
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctactgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 515 - DNA, 1017 bp, Artificial Sequence
  egc10
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtatggaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 516 - DNA, 1017 bp, Artificial Sequence
  egd9
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttggaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccgggtcaaagatcattactgaagataccaagaaggctatgaagaagtttttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 517 - DNA, 1017 bp, Artificial Sequence
  egg8
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtcaagaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 518 - DNA, 1017 bp, Artificial Sequence
  ehg1
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacaacactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 519 - DNA, 1017 bp, Artificial Sequence
  ehg2
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagactgtactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 520 - DNA, 1017 bp, Artificial Sequence
  ehh6
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacagaactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 521 - DNA, 1017 bp, Artificial Sequence
  ehh9
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagaccatactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 522 - DNA, 1017 bp, Artificial Sequence
  ehh10
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacccaactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 523 - DNA, 1017 bp, Artificial Sequence
  ehh12
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagaccaaactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 524 - DNA, 1017 bp, Artificial Sequence
  EKC5
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctttaagaaagttggcctccgaacacccagctgaagttgtcggtgaagaaattagatccttgtactcctggtccgacgaagacaagttgattaacaactga

SEQ ID NO: 525 - DNA, 1017 bp, Artificial Sequence
  EKg4
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggcttgtagaaagttggcctccgaacacccagctgaagttgtcggtgaagaaattagatccttgtactcctggtccgacgaagacaagttgattaacaactga

SEQ ID NO: 526 - DNA, 1017 bp, Artificial Sequence
  ejf5
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatcaagctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 527 - DNA, 1017 bp, Artificial Sequence
  ejb8
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggattgtgctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 528 - DNA, 1017 bp, Artificial Sequence
  eja1
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatactgctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 529 - DNA, 1017 bp, Artificial Sequence
  ejb10
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatgaagctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacactaaggctatgagaaagttggcctccgaacacccagctgaagttgtcggtgaagaaattagatccttgtactcctggtccgacgaagacaagttgattaacaactga

SEQ ID NO: 530 - DNA, 4978 bp, Artificial Sequence
  K9ALL3_PBAD-KARI
aagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggctaacaggaggaagtttaaacagtatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaagctcaggctttgttgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagag

SEQ ID NO: 531 - DNA, 4978 bp, Artificial Sequence
  K9YW25_PBAD-KARI
aagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggctaacaggaggaagtttaaacagtatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaagctcaggctttgatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagag

SEQ ID NO: 532 - DNA, 9612 bp, Artificial Sequence
  K8SB2_SH_81
catcatcacagtttaaacagtatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagtcaccggtggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgttt

SEQ ID NO: 533 - DNA, 12304 bp, Artificial Sequence
  K9ALL3_DHAD
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaagctcaggctttgttgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 534 - protein, 338 aa, Artificial Sequence
  ECB11
MAKIYYQEDCNLSLLDGKTIAVIGYGSQGHAHALNAKESGCNVIIGLFEGAEEWKRAEEQGFEVYTAAEAAKKADIIMTLIPDEKQATMYKNDIEPNLEAGNMLMFAHGFNIHFGCIVPPKDVDVTMIAPKGPGHTVRSEYEEGKGVPCLVAWEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 535 - protein, 338 aa, Artificial Sequence
  EC2a2
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAKEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 536 - protein, 338 aa, Artificial Sequence
  EC2B12
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVATEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 537 - protein, 338 aa, Artificial Sequence
  egc10
MAKIYYQEDCNLSLLDGKTIAVIGYGSQGHAHALNAKESGCNVIIGLFEGAEEWKRAEEQGMEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 538 - protein, 338 aa, Artificial Sequence
  egd9
MAKIYYQEDCNLSLLDGKTIAVIGYGSQGHAHALNAKESGCNVIIGLFEGAEEWKRAEEQGLEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGSKIITEDTKKAMKKFLSDIQDGTFAKDFLVDMSDAGSQVHTKAMRKLASEHPAEVVGEEIRSLYSWSDEDKLINN

SEQ ID NO: 539 - protein, 338 aa, Artificial Sequence
  egg8
MAKIYYQEDCNLSLLDGKTIAVIGYGSQGHAHALNAKESGCNVIIGLFEGAEEWKRAEEQGQEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 540 - protein, 338 aa, Artificial Sequence
  ehg1
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDNTGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 541 - protein, 338 aa, Artificial Sequence
  ehg2
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDCTGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 542 - protein, 338 aa, Artificial Sequence
  ehg6
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDRTGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 543 - protein, 338 aa, Artificial Sequence
  ehg9
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDHTGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 544 - protein, 338 aa, Artificial Sequence
  ehg10
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDPTGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 545 - protein, 338 aa, Artificial Sequence
  ehg12
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDQTGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 546 - protein, 338 aa, Artificial Sequence
  EKC5
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKALRKLASEHPAEVVGEEIRSLYSWSDEDKLINN

SEQ ID NO: 547 - protein, 338 aa, Artificial Sequence
  EKg4
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKACRKLASEHPAEVVGEEIRSLYSWSDEDKLINN

SEQ ID NO: 548 - protein, 338 aa, Artificial Sequence
  ejf5
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDQALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 549 - protein, 338 aa, Artificial Sequence
  ejb8
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDCALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 550 - protein, 338 aa, Artificial Sequence
  eja1
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDTALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 551 - protein, 338 aa, Artificial Sequence
  ejb10
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDEALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 552 - protein, 338 aa, Artificial Sequence
  E147V
MAKIYYQEDCNLSLLDGKTIAVIGYGSQGHAHALNAKESGCNVIIGLLEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYVEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 553 - protein, 338 aa, Artificial Sequence
  K9_Lucy_SH
MAKIYYQEDCNLSLLDGKTIAVIGYGSQGHAHALNAKESGCNVIIGLLEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 554 - DNA, 40 bp, Artificial Sequence
  H37N1
gttctcaaggtcacgctaatgccctgaatgctaaggaatc

SEQ ID NO: 555 - DNA, 40 bp, Artificial Sequence
  H37N1rev
gattccttagcattcagggcattagcgtgaccttgagaac

SEQ ID NO: 556 - DNA, 39 bp, Artificial Sequence
  G45C
cctgaatgctaaggaatcctgttgtaacgttatcattgg

SEQ ID NO: 557 - DNA, 39 bp, Artificial Sequence
  G45Crev
ccaatgataacgttacaacaggattccttagcattcagg

SEQ ID NO: 558 - DNA, 40 bp, Artificial Sequence
  I50V-FA
ggttgtaacgttatcgttggtttattcgaaggtgcggagg

SEQ ID NO: 559 - DNA, 40 bp, Artificial Sequence
  I50V-FArev
cctccgcaccttcgaataaaccaacgataacgttacaacc

SEQ ID NO: 560 - DNA, 37 bp, Artificial Sequence
  G66A
gaaaagagctgaagaacaagctttcgaagtctacacc

SEQ ID NO: 561 - DNA, 37 bp, Artificial Sequence
  G66Arev
ggtgtagacttcgaaagcttgttcttcagctcttttc

SEQ ID NO: 562 - DNA, 43 bp, Artificial Sequence
  E148G
gttagatccgaatacgaaggtggtaaaggtgtcccatgcttgg

SEQ ID NO: 563 - DNA, 43 bp, Artificial Sequence
  E148Grev
ccaagcatgggacacctttaccaccttcgtattcggatctaac

SEQ ID NO: 564 - DNA, 43 bp, Artificial Sequence
  E148Q
gttagatccgaatacgaacaaggtaaaggtgtcccatgcttgg

SEQ ID NO: 565 - DNA, 43 bp, Artificial Sequence
  E148Qrev
ccaagcatgggacacctttaccttgttcgtattcggatctaac

SEQ ID NO: 566 - DNA, 34 bp, Artificial Sequence
  V156A
gtgtcccatgcttggccgctgtcgaacaagacgc

SEQ ID NO: 567 - DNA, 34 bp, Artificial Sequence
  V156Arev
gcgtcttgttcgacagcggccaagcatgggacac

SEQ ID NO: 568 - DNA, 43 bp, Artificial Sequence
  T191S
cttggaaactaccttcagatccgaaactgaaaccgacttgttc

SEQ ID NO: 569 - DNA, 43 bp, Artificial Sequence
  T191Srev
gaacaagtcggtttcagtttcggatctgaaggtagtttccaag

SEQ ID NO: 570 - DNA, 36 bp, Artificial Sequence
  Y254F
gtttctccggtatgcgtttctctatctccaacactg

SEQ ID NO: 571 - DNA, 36 bp, Artificial Sequence
  Y254Frev
cagtgttggagatagagaaacgcataccggagaaac

SEQ ID NO: 572 - DNA, 23 bp, Artificial Sequence
  K9_158C_011212f
gcttggttgcttgtgaacaagac

SEQ ID NO: 573 - DNA, 23 bp, Artificial Sequence
  K9_158S_011212f
gcttggttgcttctgaacaagac

SEQ ID NO: 574 - DNA, 23 bp, Artificial Sequence
  K9_158L_011212f
gcttggttgctttggaacaagac

SEQ ID NO: 575 - DNA, 23 bp, Artificial Sequence
  K9_158F_011212f
gcttggttgcttttgaacaagac

SEQ ID NO: 576 - DNA, 23 bp, Artificial Sequence
  K9_158Y_011212f
gcttggttgcttatgaacaagac

SEQ ID NO: 577 - DNA, 23 bp, Artificial Sequence
  K9_158W_011212f
gcttggttgcttgggaacaagac

SEQ ID NO: 578 - DNA, 23 bp, Artificial Sequence
  K9_158P_011212f
gcttggttgctccagaacaagac

SEQ ID NO: 579 - DNA, 23 bp, Artificial Sequence
  K9_158H_011212f
gcttggttgctcatgaacaagac

SEQ ID NO: 580 - DNA, 23 bp, Artificial Sequence
  K9_158Q_011212f
gcttggttgctcaagaacaagac

SEQ ID NO: 581 - DNA, 23 bp, Artificial Sequence
  K9_158A_011212f
gcttggttgctgctgaacaagac

SEQ ID NO: 582 - DNA, 23 bp, Artificial Sequence
  K9_158D_011212f
gcttggttgctgatgaacaagac

SEQ ID NO: 583 - DNA, 23 bp, Artificial Sequence
  K9_158E_011212f
gcttggttgctgaagaacaagac

SEQ ID NO: 584 - DNA, 23 bp, Artificial Sequence
  K9_158G_011212f
gcttggttgctggtgaacaagac

SEQ ID NO: 585 - DNA, 23 bp, Artificial Sequence
  K9_158I_011212f
gcttggttgctattgaacaagac

SEQ ID NO: 586 - DNA, 23 bp, Artificial Sequence
  K9_158M_011212f
gcttggttgctatggaacaagac

SEQ ID NO: 587 - DNA, 23 bp, Artificial Sequence
  K9_158T_011212f
gcttggttgctactgaacaagac

SEQ ID NO: 588 - DNA, 23 bp, Artificial Sequence
  K9_158R_011212f
gcttggttgctagagaacaagac

SEQ ID NO: 589 - DNA, 23 bp, Artificial Sequence
  K9_158K_011212f
gcttggttgctaaggaacaagac

SEQ ID NO: 590 - DNA, 23 bp, Artificial Sequence
  K9_158N_011212f
gcttggttgctaacgaacaagac

SEQ ID NO: 591 - DNA, 21 bp, Artificial Sequence
  K9_67L_011212f
gaagaacaaggtttggaagtc

SEQ ID NO: 592 - DNA, 21 bp, Artificial Sequence
  K9_67C_011212f
gaagaacaaggttgtgaagtc

SEQ ID NO: 593 - DNA, 21 bp, Artificial Sequence
  K9_67S_011212f
gaagaacaaggttctgaagtc

SEQ ID NO: 594 - DNA, 21 bp, Artificial Sequence
  K9_67Y_011212f
gaagaacaaggttatgaagtc

SEQ ID NO: 595 - DNA, 21 bp, Artificial Sequence
  K9_67W_011212f
gaagaacaaggttgggaagtc

SEQ ID NO: 596 - DNA, 21 bp, Artificial Sequence
  K9_67V_011212f
gaagaacaaggtgttgaagtc

SEQ ID NO: 597 - DNA, 21 bp, Artificial Sequence
  K9_67A_011212f
gaagaacaaggtgctgaagtc

SEQ ID NO: 598 - DNA, 21 bp, Artificial Sequence
  K9_67D_011212f
gaagaacaaggtgatgaagtc

SEQ ID NO: 599 - DNA, 21 bp, Artificial Sequence
  K9_67E_011212f
gaagaacaaggtgaagaagtc

SEQ ID NO: 600 - DNA, 21 bp, Artificial Sequence
  K9_67G_011212f
gaagaacaaggtggtgaagtc

SEQ ID NO: 601 - DNA, 21 bp, Artificial Sequence
  K9_67I_011212f
gaagaacaaggtattgaagtc

SEQ ID NO: 602 - DNA, 21 bp, Artificial Sequence
  K9_67M_011212f
gaagaacaaggtatggaagtc

SEQ ID NO: 603 - DNA, 21 bp, Artificial Sequence
  K9_67T_011212f
gaagaacaaggtactgaagtc

SEQ ID NO: 604 - DNA, 21 bp, Artificial Sequence
  K9_67R_011212f
gaagaacaaggtagagaagtc

SEQ ID NO: 605 - DNA, 21 bp, Artificial Sequence
  K9_67K_011212f
gaagaacaaggtaaggaagtc

SEQ ID NO: 606 - DNA, 21 bp, Artificial Sequence
  K9_67N_011212f
gaagaacaaggtaacgaagtc

SEQ ID NO: 607 - DNA, 21 bp, Artificial Sequence
  K9_67Q_011212f
gaagaacaaggtcaagaagtc

SEQ ID NO: 608 - DNA, 21 bp, Artificial Sequence
  K9_67H_011212f
gaagaacaaggtcatgaagtc

SEQ ID NO: 609 - DNA, 21 bp, Artificial Sequence
  K9_67P_011212f
gaagaacaaggtccagaagtc

SEQ ID NO: 610 - DNA, 21 bp, Artificial Sequence
  K9_162V_011212f
gtcgaacaagacgttactggc

SEQ ID NO: 611 - DNA, 21 bp, Artificial Sequence
  K9_162D_011212f
gtcgaacaagacgatactggc

SEQ ID NO: 612 - DNA, 21 bp, Artificial Sequence
  K9_162E_011212f
gtcgaacaagacgaaactggc

SEQ ID NO: 613 - DNA, 21 bp, Artificial Sequence
  K9_162G_011212f
gtcgaacaagacggtactggc

SEQ ID NO: 614 - DNA, 21 bp, Artificial Sequence
  K9_162F_011212f
gtcgaacaagactttactggc

SEQ ID NO: 615 - DNA, 21 bp, Artificial Sequence
  K9_162L_011212f
gtcgaacaagacttgactggc

SEQ ID NO: 616 - DNA, 21 bp, Artificial Sequence
  K9_162C_011212f
gtcgaacaagactgtactggc

SEQ ID NO: 617 - DNA, 21 bp, Artificial Sequence
  K9_162S_011212f
gtcgaacaagactctactggc

SEQ ID NO: 618 - DNA, 21 bp, Artificial Sequence
  K9_162Y_011212f
gtcgaacaagactatactggc

SEQ ID NO: 619 - DNA, 21 bp, Artificial Sequence
  K9_162W_011212f
gtcgaacaagactggactggc

SEQ ID NO: 620 - DNA, 21 bp, Artificial Sequence
  K9_162I_011212f
gtcgaacaagacattactggc

SEQ ID NO: 621 - DNA, 21 bp, Artificial Sequence
  K9_162M_011212f
gtcgaacaagacatgactggc

SEQ ID NO: 622 - DNA, 21 bp, Artificial Sequence
  K9_162T_011212f
gtcgaacaagacactactggc

SEQ ID NO: 623 - DNA, 21 bp, Artificial Sequence
  K9_162R_011212f
gtcgaacaagacagaactggc

SEQ ID NO: 624 - DNA, 21 bp, Artificial Sequence
  K9_162K_011212f
gtcgaacaagacaagactggc

SEQ ID NO: 625 - DNA, 21 bp, Artificial Sequence
  K9_162N_011212f
gtcgaacaagacaacactggc

SEQ ID NO: 626 - DNA, 21 bp, Artificial Sequence
  K9_162Q_011212f
gtcgaacaagaccaaactggc

SEQ ID NO: 627 - DNA, 21 bp, Artificial Sequence
  K9_162H_011212f
gtcgaacaagaccatactggc

SEQ ID NO: 628 - DNA, 21 bp, Artificial Sequence
  K9_162P_011212f
gtcgaacaagacccaactggc

SEQ ID NO: 629 - DNA, 22 bp, Artificial Sequence
  K9_312Y_030812r
ggaggccaactttcttatagcc

SEQ ID NO: 630 - DNA, 22 bp, Artificial Sequence
  K9_312A_030812r
ggaggccaactttctagcagcc

SEQ ID NO: 631 - DNA, 22 bp, Artificial Sequence
  K9_312L_030812r
ggaggccaactttcttaaagcc

SEQ ID NO: 632 - DNA, 22 bp, Artificial Sequence
  K9_312R_030812r
ggaggccaactttcttctagcc

SEQ ID NO: 633 - DNA, 22 bp, Artificial Sequence
  K9_312K_030812r
ggaggccaactttcttttagcc

SEQ ID NO: 634 - DNA, 22 bp, Artificial Sequence
  K9_312F_030812r
ggaggccaactttctaaaagcc

SEQ ID NO: 635 - DNA, 22 bp, Artificial Sequence
  K9_312P_030812r
ggaggccaactttctaggagcc

SEQ ID NO: 636 - DNA, 22 bp, Artificial Sequence
  K9_312N_030812r
ggaggccaactttctattagcc

SEQ ID NO: 637 - DNA, 22 bp, Artificial Sequence
  K9_312I_030812r
ggaggccaactttctaatagcc

SEQ ID NO: 638 - DNA, 22 bp, Artificial Sequence
  K9_312C_030812r
ggaggccaactttctacaagcc

SEQ ID NO: 639 - DNA, 22 bp, Artificial Sequence
  K9_312H_030812r
ggaggccaactttctatgagcc

SEQ ID NO: 640 - DNA, 22 bp, Artificial Sequence
  K9_312V_030812r
ggaggccaactttctaacagcc

SEQ ID NO: 641 - DNA, 22 bp, Artificial Sequence
  K9_312D_030812r
ggaggccaactttctatcagcc

SEQ ID NO: 642 - DNA, 22 bp, Artificial Sequence
  K9_312G_030812r
ggaggccaactttctaccagcc

SEQ ID NO: 643 - DNA, 22 bp, Artificial Sequence
  K9_312S_030812r
ggaggccaactttctagaagcc

SEQ ID NO: 644 - DNA, 22 bp, Artificial Sequence
  K9_312T_030812r
ggaggccaactttctagtagcc

SEQ ID NO: 645 - DNA, 22 bp, Artificial Sequence
  K9_312Q_030812r
ggaggccaactttctttgagcc

SEQ ID NO: 646 - DNA, 22 bp, Artificial Sequence
  K9_312E_030812r
ggaggccaactttctttcagcc

SEQ ID NO: 647 - DNA, 22 bp, Artificial Sequence
  K9_312W_030812r
ggaggccaactttctccaagcc

SEQ ID NO: 648 - DNA, 25 bp, Artificial Sequence
  K9_169I_030812f
gcaaggctttggatattgctttggc

SEQ ID NO: 649 - DNA, 25 bp, Artificial Sequence
  K9_169V_030812f
gcaaggctttggatgttgctttggc

SEQ ID NO: 650 - DNA, 25 bp, Artificial Sequence
  K9_169R_030812f
gcaaggctttggatagagctttggc

SEQ ID NO: 651 - DNA, 25 bp, Artificial Sequence
  K9_169T_030812f
gcaaggctttggatactgctttggc

SEQ ID NO: 652 - DNA, 25 bp, Artificial Sequence
  K9_169K_030812f
gcaaggctttggataaggctttggc

SEQ ID NO: 653 - DNA, 25 bp, Artificial Sequence
  K9_169N_030812f
gcaaggctttggataacgctttggc

SEQ ID NO: 654 - DNA, 25 bp, Artificial Sequence
  K9_169A_030812f
gcaaggctttggatgctgctttggc

SEQ ID NO: 655 - DNA, 25 bp, Artificial Sequence
  K9_169D_030812f
gcaaggctttggatgatgctttggc

SEQ ID NO: 656 - DNA, 25 bp, Artificial Sequence
  K9_169E_030812f
gcaaggctttggatgaagctttggc

SEQ ID NO: 657 - DNA, 25 bp, Artificial Sequence
  K9_169G_030812f
gcaaggctttggatggtgctttggc

SEQ ID NO: 658 - DNA, 25 bp, Artificial Sequence
  K9_169F_030812f
gcaaggctttggattttgctttggc

SEQ ID NO: 659 - DNA, 25 bp, Artificial Sequence
  K9_169L_030812f
gcaaggctttggatttggctttggc

SEQ ID NO: 660 - DNA, 25 bp, Artificial Sequence
  K9_169C_030812f
gcaaggctttggattgtgctttggc

SEQ ID NO: 661 - DNA, 25 bp, Artificial Sequence
  K9_169S_030812f
gcaaggctttggattctgctttggc

SEQ ID NO: 662 - DNA, 25 bp, Artificial Sequence
  K9_169Y_030812f
gcaaggctttggattatgctttggc

SEQ ID NO: 663 - DNA, 25 bp, Artificial Sequence
  K9_169W_030812f
gcaaggctttggattgggctttggc

SEQ ID NO: 664 - DNA, 25 bp, Artificial Sequence
  K9_169P_030812f
gcaaggctttggatccagctttggc

SEQ ID NO: 665 - DNA, 25 bp, Artificial Sequence
  K9_169H_030812f
gcaaggctttggatcatgctttggc

SEQ ID NO: 666 - DNA, 25 bp, Artificial Sequence
  K9_169Q_030812f
gcaaggctttggatcaagctttggc

SEQ ID NO: 667 - protein, 338 aa, Pseudomonas fluorescens
MKVFYDKDCDLSIIQGKKVAIIGYGSQGHAQACNLKDSGVDVTVGLRKGSATVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 668 - protein, 335 aa, Sulfolobus solfataricus
MKCTSKIYTDNDANLDLIKGKRIAVLGYGSQGRAWAQNLRDSGLNVVVGLEREGKSWELAKSDGITPLHTKDAVKDADIIIFLVPDMVQRTLWLESVQPYMKKGADLVFAHGFNIHYKLIDPPKDSDVYMIAPKGPGPTVREYYKAGGGVPALVAVHQDVSGTALHKALAIAKGIGATRAGVIPTTFKEETETDLFGEQVILVGGIMELMRAAFETLVEEGYQPEVAYFETINELKMLVDLVYEKGISGMLKAVSDTAKYGGMTVGKFVIDESVRKRMKEALQRIKSGKFAEEWVEEYGRGMPTVVNGLSNVQNSLEEKIGNQLRDLVQKGKPKS

SEQ ID NO: 669 - protein, 328 aa, Pyrobaculum aerophilum
MAKIYTDREASLEPLKGKTIAVIGYGIQGRAQALNLRDSGLEVIIGLRRGGKSWELATSEGFRVYEIGEAVRKADVILVLIPDMEQPKVWQEQIAPNLKEGVVVDFAHGFNVHFGLIKPPKNIDVIMVAPKAPGKAVREEYLAGRGVPALVAVYQDYSGSALKYALALAKGIGATRAGVIETTFAEETETDLIGEQIVLVGGLMELIKKGFEVLVEMGYQPEVAYFEVLNEAKLIMDLIWQRGIYGMLNGVSDTAKYGGLTVGPRVIDENVKRKMKEAAMRVKSGEFAKEWVEEYNRGAPTLRKLMEEARTHPIEKVGEEMRKLLFGP

SEQ ID NO: 670 - protein, 331 aa, Natronomonas pharaonis
MTDATIYYDDDAESTVLDDKTVAVLGYGSQGHAHAQNLDDSGVDVVVGLREDSSSRSAAEADGLDVATPRGAAEQADLVSVLVPDTVQPAVYEQIEDVLQPGDTLQFAHGFNIHYGQIEPSEDVNVTMVAPKSPGHLVRRNYENDEGTPGLLAVYQDPSGEAHDLGLAYAKAIGCTRAGVVETTFREETETDLFGEQAVLCGGVTSLVKTGYETLVDAGYSPEMAYFECLNELKLIVDLMYEGGNSEMWDSVSDTAEYGGLTRGDRIVDDHAREKMEEVLEEVQNGTFAREWISENQAGRPSYKQLRAAEKNHDIEAVGEDLRALFAWGDD

SEQ ID NO: 671 - protein, 342 aa, Bacillus subtilis
MVKVYYNGDIKENVLAGKTVAVIGYGSQGHAHALNLKESGVDVIVGVRQGKSFTQAQEDGHKVFSVKEAAAQAEIIMVLLPDEQQQKVYEAEIKDELTAGKSLVFAHGFNVHFHQIVPPADVDVFLVAPKGPGHLVRRTYEQGAGVPALFAIYQDVTGEARDKALAYAKGIGGARAGVLETTFKEETETDLFGEQAVLCGGLSALVKAGFETLTEAGYQPELAYFECLHELKLIVDLMYEEGLAGMRYSISDTAQWGDFVSGPRVVDAKVKESMKEVLKDIQNGTFAKEWIVENQVNRPRFNAINASENEHQIEVVGRKLREMMPFVKQGKKKEAVVSVAQN

SEQ ID NO: 672 - protein, 338 aa, Corynebacterium glutamicum
MAIELLYDADADLSLIQGRKVAIVGYGSQGHAHSQNLRDSGVEVVIGLREGSKSAEKAKEAGFEVKTTAEAAAWADVIMLLAPDTSQAEIFTNDIEPNLNAGDALLFGHGLNIHFDLIKPADDIIVGMVAPKGPGHLVRRQFVDGKGVPCLIAVDQDPTGTAQALTLSYAAAIGGARAGVIPTTFEAETVTDLFGEQAVLCGGTEELVKVGFEVLTEAGYEPEMAYFEVLHELKLIVDLMFEGGISNMNYSVSDTAEFGGYLSGPRVIDADTKSRMKDILTDIQDGTFTKRLIANVENGNTELEGLRASYNNHPIEETGAKLRDLMSWVKVDARAETA

SEQ ID NO: 673 - protein, 339 aa, Phaeospririlum molischianum
  misc_feature (310)..(310): Xaa can be any naturally occurring amino acid
MRVYYDRDADVNLIKSKKVAVIGYGSQGHAHVLNLRDSGVKDVAVALRPGSASIKKAEAEGLKVLTPAEAAAWADVVMILTPDELQADLYKSELAANLKPGAALVFAHGLAIHFKLIEARADLDVFMVAPKGPGHTVRGEYLKGGGVPCLVAVAQNPTGNALELALSYASAIGGGRSGIIETTFREECETDLFGEQVVLCGGLSKLIQYGFETLVEAGYAPEMAYFECLHEVKLIVDLIYEGGIANMRYSISNTAEYGDYVTGSRIITEATKAEMKRVLADIQSGRFVRDWMLECKAGQPSFKATRRIQXEHVIEVVGEKLRGMMPWISKNKLVDKARN

SEQ ID NO: 674 - protein, 338 aa, Ralstonia solanacearum
MKVFYDKDADLSLIKGKNVTIIGYGSQGHAHALNLNDSGVKVTVGLRKNGASWNKAVNAGLQVKEVAEAVKDADVVMILLPDEQIADVYKNEVHGNIKQGAALAFAHGFNVHYGAVIPRADLDVIMVAPKAPGHTVRGTYAQGGGVPHLIAVHQDKSGSARDIALSYATANGGGRAGIIETNFREETETDLFGEQAVLCGGTVELIKAGFETLVEAGYAPEMAYFECLHELKLIVDLIYEGGIGNMNYSISNNAEYGEYVTGPRVVTAETKQAMKQCLHDIQTGEYAKSFLLENKAGAPTLISRRRLTADHQIEQVGAKLRAMMPWIAKNKLVDQSKN

SEQ ID NO: 675 - protein, 339 aa, Zymomonas mobilis
MKVYYDSDADLGLIKSKKIAILGYGSQGHAHAQNLRDSGVAEVAIALRPDSASVKKAQDAGFKVLTNAEAAKWADILMILAPDEHQAAIYAEDLKDNLRPGSAIAFAHGLNIHFGLIEPRKDIDVFMIAPKGPGHTVRSEYVRGGGVPCLVAVDQDASGNAHDIALAYASGIGGGRSGVIETTFREEVETDLFGEQAVLCGGLTALITAGFETLTEAGYAPEMAFFECMHEMKLIVDLIYEAGIANMRYSISNTAEYGDIVSGPRVINEESKKAMKAILDDIQSGRFVSKFVLDNRAGQPELKAARKRMAAHPIEQVGARLRKMMPWIASNKLVDKARN

SEQ ID NO: 676 - protein, 338 aa, Alkalilimnicola ehrlichei
MQVYYDKDADLSIIQGKKVAVIGYGSQGHAHANNLKESGVDVVVGLREGSSSAAKAQKAGLAVASIEDAAAQADVVMILAPDEHQAVIYHNQIAPNVKPGAAIAFAHGFNIHFGQIQPAADLDVIMVAPKGPGHLVRSTYVEGGGVPSLIAIHQDATGKAKDIALSYASANGGGRAGVIETSFREETETDLFGEQAVLCGGITSLIQAGFETLVEAGYAPEMAYFECLHETKLIVDLLYQGGIANMRYSISNTAEYGDFTRGPRVINEESREAMREILAEIQEGEFAREFVLENQAGCPTLTARRRLAAEHEIEVVGERLRGMMPWINANKLVDKDKN

SEQ ID NO: 677 - protein, 340 aa, Campylobacter lari
MAVSIYYDKDCDINLIKSKKVAIIGFGSQGHAHAMNLRDSGVEVIIGLKEGGQSWAKAQKANFIVKSVKEATKEADLIMILAPDEIQSEIFNEEIKPELKAGKTLAFAHGFNIHYGQIVAPKGIDVIMIAPKAPGHTVRHEFSIGGGTPCLIAIHQDESKNAKNLALSYASAIGGGRTGIIETTFKAETETDLFGEQAVLCGGLSALIQAGFETLVEAGYEPEMAYFECLHEMKLIVDLIYQGGIADMRYSVSNTAEYGDYITGPKIITKETKEAMKGVLKDIQNGSFAKDFILERRANFARMHAERKLMNDSLIEKTGRELRAMMPWISAKKLVDKDKN

SEQ ID NO: 678 - protein, 338 aa, Marinobacter aquaeolei
MQVYYDKDCDLSIIQGKKVAILGFGSQGHAHACNLKDSGVDVVVGLRAGSSSIAKAEAYGLKTSDVASAVASADVVMVLTPDEFQAQLYREEIEPNLKQGATLAFAHGFAIHYNQIVPRKDLDVIMVAPKAPGHTVRTEFTKGGGIPDLIAIFQDASGNAKNVALSYASGIGGGRTGIIETTFKDETETDLFGEQAVLCGGAVELVKAGFETLTEAGYAPEMAYFECLHELKLIVDLMYEGGIANMNYSISNNAEYGEYVTGPEVINEQSREAMRNALKRIQSGEYAKMFISEGALNYPSMTARRRQNAAHEIETVGEKLRSMMPWISANKIVDKDKN

SEQ ID NO: 679 - protein, 338 aa, Psychrobacter arcticus
MNVYYDKDCDLSIVQGKKVAIIGYGSQGHAHALNLQDSNVDVTVGLRADSGSWKKAENAGLKVAEVEEAVKAADIIMILTPDEFQKELYNDVIEPNIKQGATLAFAHGFAIHYNQVIPRSDLDVIMVAPKAPGHTVRSEFAKGGGIPDLIAIYQDASGQAKQLALSYAAGVGGGRSGIIETTFKDETETDLFGEQAVLCGGAVELVKMGFETLTEAGYAPEMAYFECLHELKLIVDLMYEGGIADMNYSISNNAEYGEYVTGPEVINEQSREAMRNALKRIQSGEYAKMFISEGATNYPSMTARRRNNAEHQIEITGAKLRGMMPWIGGNKIIDKDKN

SEQ ID NO: 680 - protein, 338 aa, Hahella chejuensis
MQVYYDKDCDLSIIQGKKVAIIGYGSQGHAHANNLKDSGVDVCVGLRKGSGSWAKAENAGLAVKEVAEAVAGADVVMILTPDEFQAQLYKSEIEPNLKSGATLAFAHGFSIHYNQIVPRADLDVIMIAPKAPGHTVRSEFVKGGGIPDLIAIFQDASGSAKDLALSYASGVGGGRTGIIETTFKDETETDLFGEQAVLCGGAVELVKAGFETLVEAGYAPEMAYFECLHELKLIVDLMYEGGIANMNYSISNNAEYGEYVTGPEVINDQSRAAMRNALKRIQDGEYAKMFIAEGAHNYPSMTAYRRNNAAHPIEQVGEKLRSMMPWIASNKIVDKSKN

SEQ ID NO: 681 - protein, 338 aa, Thiobacillus denitrificans
MKVYYDKDADLSLIKQRKVAIVGYGSQGHAHANNLKDSGVDVTVALRPGSASAKKAENAGLTVKSVPEAVAGADLVMILTPDEFQSRLYRDEIEPNIKQGATLAFAHGFSIHYNQVVPRADLDVIMIAPKAPGHTVRSEFVKGGGIPDLIAIYQDASGKAKETALSYASAIGGGRTGIIETTFKDETETDLFGEQAVLCGGAVELVKAGFDTLVEAGYAPEMAYFECLHELKLIVDLMYEGGIANMNYSISNNAEYGEYVTGVKVINEQSRAAMKECLANIQNGAYAKRFILEGQANYPEMTAWRRNNAAHQIEVVGAKLRSMMPWIAANKLVDHSKN

SEQ ID NO: 682 - protein, 338 aa, Azotobacter vinelandii
MKVYYDKDCDLSIIQSKKVAIIGYGSQGHAHACNLKDSGVDVYVGLRAGSASVAKAEAHGLTVKSVKDAVAAADVVMILTPDEFQGRLYKDEIEPNLKKGATLAFAHGFSIHYNQVVPRADLDVIMIAPKAPGHTVRSEFVRGGGIPDLIAVYQDASGNAKNLALSYACGVGGGRTGIIETTFKDETETDLFGEQAVLCGGCVELVKAGFETLVEAGYAPEMAYFECLHELKLIVDLMFEGGIANMNYSISNNAEYGEYVTGPEVINEQSRQAMRNALKRIQDGEYAKMFITEGAANYPSMTAYRRNNAAHQIEVVGEKLRTMMPWIAANKIVDKTKN

SEQ ID NO: 683 - protein, 338 aa, Pseudomonas syringae
MKVFYDKDCDLSIIQGKKVAIIGYGSQGHAQACNLKDSGVDVTVGLRKGSATVAKAEAHGLKVTDVASAVAAADLVMILTPDEFQSQLYKNEVEPNLKKGATLAFSHGFAIHYNQVVPRADLDVIMIAPKAPGHTVRTEFVKGGGIPDLIAVYQDASGNAKNVALSYASGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEKLRSMMPWIAANKIVDKDKN

SEQ ID NO: 684 - protein, 338 aa, Pseudomonas syringae
MKVFYDKDCDLSIIQGKKVAIIGYGSQGHAQACNLKDSGVDVTVGLRKGSATVAKAEAHGLKVTDVASAVAAADLVMILTPDEFQSQLYKNEVEPNLKKGATLAFSHGFAIHYNQVVPRADLDVIMIAPKAPGHTVRTEFVKGGGIPDLIAVYQDASGNAKNVALSYASGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFITEGATGYPSMTAKRRNNAEHGIEVIGEKLRSMMPWIAANKIVDKDKN

SEQ ID NO: 685 - protein, 338 aa, Pseudomonas putida
MKVFYDKDCDLSIIQGKKVAIIGYGSQGHAQACNLKDSGVDVTVGLRKGSATVAKAEAHGLKVADVATAVAAADLVMILTPDEFQGALYKNEIEPNIKKGATLAFSHGFSIHYNQVVPRADLDVIMIAPKAPGHTVRSEFVKGGGIPDLIAIYQDASGNAKNVALSYASGVGGGRTGIIETTFKDETETDLFGEQAVLCGGTVELVKAGFETLVEAGYAPEMAYFECLHELKLIVDLMYEGGIANMNYSISNNAEYGEYVTGPEVINEESRKAMRNALKRIQDGEYAKMFISEGATNYPSMTAKRRNNAAHGIEIIGEQLRSMMPWISANKIVDKTKN

SEQ ID NO: 686 - protein, 338 aa, Pseudomonas entomophila
MKVFYDKDCDLSIIQGKKVAIIGYGSQGHAQACNLKDSGVDVTIGLRKGSATVAKAEAHGLKVTDVATAVAAADLVMILTPDEFQGQLYKQEIEPNIKKGATLAFSHGFAIHYNQVVPRADLDVIMIAPKAPGHTVRSEFVKGGGIPDLIAIYQDASGNAKNVALSYASGVGGGRTGIIETTFKDETETDLFGEQAVLCGGTVELVKAGFETLVEAGYAPEMAYFECLHELKLIVDLMYEGGIANMNYSISNNAEYGEYVTGPEVINEESRKAMRNALKRIQDGEYAKMFISEGATNYPSMTAKRRNNAAHGIEIIGEQLRSMMPWISANKIVDKTKN

SEQ ID NO: 687 - protein, 338 aa, Pseudomonas mendocina
MKVYYDKDCDLSIIQGKKVAIIGYGSQGHAQACNLKDSGVDVTIGLRKGSATVAKAEAHGLKVTDVASAVAAADLVMILTPDEFQGQLYKNEIEPNIKKGATLAFSHGFAIHYNQVVPRADLDVIMIAPKAPGHTVRTEFVKGGGIPDLIAVYQDASGNAKNVALSYASGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEVIGEQLRAMMPWIAANKIVDKTKN

SEQ ID NO: 688 - protein, 338 aa, Pseudomonas aeruginosa
MRVFYDKDCDLSIIQGKKVAIIGYGSQGHAHACNLKDSGVDVTVGLRSGSATVAKAEAHGLKVADVKTAVAAADVVMILTPDEFQGRLYKEEIEPNLKKGATLAFAHGFSIHYNQVVPRADLDVIMIAPKAPGHTVRSEFVKGGGIPDLIAIYQDASGNAKNVALSYACGVGGGRTGIIETTFKDETETDLFGEQAVLCGGCVELVKAGFETLVEAGYAPEMAYFECLHELKLIVDLMYEGGIANMNYSISNNAEYGEYVTGPEVINAESRAAMRNALKRIQDGEYAKMFITEGAANYPSMTAYRRNNAAHPIEQIGEKLRAMMPWIAANKIVDKSKN

SEQ ID NO: 689 - protein, 336 aa, Bacillus cereus
MAKVYYEKDVTVNVLKEKKVAIIGYGSQGHAHAQNLRDNGFDVVVGLRKGKSWDKAKEDGFSVYTVAEAAKQADVVMILLPDELQPEVYEAEIAPNLQAGNSLVFAHGFNVHFDQVKPPANVDVFLVAPKGPGHLVRRTFSEGGAVPALFAVYQDATGVATEKALSYADGIGATRAGVLETTFKEETETDLFGEQAVLCGGVTALVKAGFETLVDAGYQPELAYFECLHELKLIVDLMYEGGLENMRYSVSDTAQWGDFVSGPRVVTEDTKKAMGTVLAEIQDGTFARGWIAEHKAGRPNFHATNEKENEHEIEVVGRKLREMMPFVQPRVKVGMK

SEQ ID NO: 690 - protein, 335 aa, Bacillus cereus AT
MKTYYEKDANVELLKGKTVAVIGYGSQGHAQAQNLRDSGVEVVVGVRPGKSFEVAKTDGFEVMSVSEAVRTAQVVQMLLPDEQQAHVYKAGVEENLREGQMLLFSHGFNIHFGQINPPSYVDVAMVAPKSPGHLVRRVFQEGNGVPALVAVHQDATGTALHVALAYAKGVGCTRAGVIETTFQEETETDLFGEQTVLCGGVTALVKAGFETLTEGGYRPEIAYFECLHELKLIVDLMYEGGLTNMRHSISDTAEFGDYVTGSRIVTDETKKEMKRVLTEIQQGEFAKKWILENQAGRPTYNAMKKAEQNHQLEKVGAELREMMSWIDAPKELVKK

SEQ ID NO: 691 - protein, 595 aa, Spinacia oleracea
MAATAATTFSLSSSSSTSAAASKALKQSPKPSALNLGFLGSSSTIKACRSLKAARVLPSGANGGGSALSAQMVSAPSINTPSATTFDFDSSVFKKEKVTLSGHDEYIVRGGRNLFPLLPDAFKGIKQIGVIGWGSQAPAQAQNLKDSLTEAKSDVVVKIGLRKGSNSFAEARAAGFSEENGTLGDMWETISGSDLVLLLISDSAQADNYEKVFSHMKPNSILGLSHGFLLGHLQSLGQDFPKNISVIAVCPKGMGPSVRRLYVQGKEVNGAGINSSFAVHQDVDGRATDVALGWSIALGSPFTFATTLEQEYKSDIFGERGILLGAVHGIVECLFRRYTESGMSEDLAYKNTVECITGVISKTISTKGMLALYNSLSEEGKKDFQAAYSASYYPSMDILYECYEDVASGSEIRSVVLAGRRFYEKEGLPAFPMGKIDQTRMWKVGEKVRSVRPAGDLGPLYPFTAGVYVALMMAQIEILRKKGHSYSEIINESVIEAVDSLNPFMHARGVSFMVDNCSTTARLGSRKWAPRFDYILSQQALVAVDNGAPINQDLISNFLSDPVHEAIGVCAQLRPSVDISVTADADFVRPELRQA

SEQ ID NO: 692 - DNA, 44 bp, Artificial sequence
  Primer AlaLL1
ccagatgaagctcaggctttgttgtacaaaaacgacatcgaacc

SEQ ID NO: 693 - DNA, 44 bp, Artificial sequence
  Primer AlaLL1rev
ggttcgatgtcgtttttgtacaacaaagcctgagcttcatctgg

SEQ ID NO: 694 - DNA, 43 bp, Artificial sequence; identical to SEQ ID NO: 568
  Primer T191S

SEQ ID NO: 695 - DNA, 43 bp, Artificial sequence; identical to SEQ ID NO: 569
  Primer T191Srev

SEQ ID NO: 696 - DNA, 36 bp, Artificial sequence; identical to SEQ ID NO: 570
  Primer Y254F

SEQ ID NO: 697 - DNA, 36 bp, Artificial sequence; identical to SEQ ID NO: 571
  Primer Y254Frev

SEQ ID NO: 698 - DNA, 46 bp, Artificial sequence
  Primer K278M
cattactgaagataccaagatggctatgaagaagattttgtctgac

SEQ ID NO: 699 - DNA, 46 bp, Artificial sequence
  Primer K278Mrev
gtcagacaaaatcttcttcatagccatcttggtatcttcagtaatg

SEQ ID NO: 700 - DNA, 43 bp, Artificial sequence; identical to SEQ ID NO: 568
  Primer T191S

SEQ ID NO: 701 - DNA, 43 bp, Artificial sequence; identical to SEQ ID NO: 569
  Primer T191Srev

SEQ ID NO: 702 - DNA, 43 bp, Artificial sequence; identical to SEQ ID NO: 568
  Primer T191S

SEQ ID NO: 703 - DNA, 43 bp, Artificial sequence; identical to SEQ ID NO: 569
  Primer T191Srev

SEQ ID NO: 704 - DNA, 45 bp, Artificial sequence
  primer 258-1
ggtatgcgttactctatctcctccactgctgaatacggtgactac

SEQ ID NO: 705 - DNA, 45 bp, Artificial sequence
  Primer 258-1r
gtagtcaccgtattcagcagtggaggagatagagtaacgcatacc

The invention claimed is:

1. A recombinant yeast host cell comprising an isobutanol biosynthetic pathway, and
   a. a heterologous polypeptide with ketol-acid reductoisomerase activity having at least 99% identity to SEQ ID NO: 234 (JM44) or a heterologous polynucleotide encoding said heterologous polypeptide where the isobutanol production pathway comprises the following substrate to product conversions:
      i) pyruvate to acetolactate
      ii) acetolactate to 2,3-dihydroxyisovalerate
      iii) 2,3-dihydroxyisovalerate to 2-ketoisovalerate
      iv) 2-ketoisovalerate to isobutyraldehyde; and e. isobutyraldehyde to isobutanol wherein more than one of the substrate to product conversions is catalyzed by an enzyme that is heterologous to the host cell.

2. The recombinant yeast host cell of claim 1, wherein all of the substrate to product conversions are catalyzed by enzymes heterologous to the host cell.

3. The recombinant yeast host cell of claim 1, wherein the host cell further comprises a deletion in an endogenous polynucleotide encoding a polypeptide having acetolactate reductase activity.

4. The recombinant yeast host cell of claim 1, wherein the host cell further comprises a deletion in an endogenous polynucleotide encoding a polypeptide having aldehyde dehydrogenase activity.

5. The recombinant yeast host cell of claim 1, wherein the host cell further comprises a deletion in an endogenous polynucleotide encoding a polypeptide having pyruvate decarboxylase activity.

6. The recombinant yeast host cell of claim 1 comprising an isobutanol production pathway comprising the following substrate to product conversions:
   a. pyruvate to acetolactate
   b. acetolactate to 2,3-dihydroxyisovalerate
   c. 2,3-dihydroxyisovalerate to 2-ketoisovalerate
   d. 2-ketoisovalerate to isobutyraldehyde; and
   e. isobutyraldehyde to isobutanol
   wherein the substrate to product conversions are catalyzed by enzymes substantially localized to the cytosol.

7. A composition comprising isobutanol and a recombinant yeast host cell of claim 1.

8. The recombinant yeast host cell of claim 1, wherein the polypeptide comprises at least one substitution at at least one of the following positions: S32, H37, K42, G45, G66, T71, A73, A79, A92, M94, D98, E100, A105, E147, E148, V156, G164, L167, M169, A176, R181, V184, T187, T191, A214, V220, L243, Y254, N258, E274, K278, A279, G304, or M312.

9. The recombinant yeast host cell of claim 1, wherein the polypeptide further comprise at least one of the following substitutions: S32Y, H37N, K42N, G45C, G66A, T71S, A73T, A79D, A92D, M94I, M94L, D98V, E100Q, A105T, E147V, E148G, E148Q, V156A, G164D, L167M, M169F, M169K, M169L, A176T, R181K, V184I, T187S, T191N, T191S, A214V, V220I, L243S, Y254F, N258S, E274, K278M, A279T, G304V, or M312K.

* * * * *